US011649505B2

(12) United States Patent
Gan et al.

(10) Patent No.: US 11,649,505 B2
(45) Date of Patent: May 16, 2023

(54) KIT FOR IDENTIFYING MALIGNANCY, AND USES THEREOF

(71) Applicant: Agency for Science, Technology and Research, Singapore (SG)

(72) Inventors: Bong Hwa Gan, Nanos (SG); Masafumi Inoue, Nanos (SG); Veronica Diermayr, Nanas (SG)

(73) Assignee: Agency for Science, Technology and Research, Singapore (SG)

(*) Notice: Subject to any disclaimer, the term of this patent is extended or adjusted under 35 U.S.C. 154(b) by 509 days.

(21) Appl. No.: 16/471,320

(22) PCT Filed: Dec. 21, 2017

(86) PCT No.: PCT/SG2017/050638
§ 371 (c)(1),
(2) Date: Jun. 19, 2019

(87) PCT Pub. No.: WO2018/117972
PCT Pub. Date: Jun. 28, 2018

(65) Prior Publication Data
US 2020/0002772 A1 Jan. 2, 2020

(30) Foreign Application Priority Data

Dec. 21, 2016 (SG) .............................. 10201610735P
May 19, 2017 (SG) ............................. 10201704134V

(51) Int. Cl.
*C12Q 1/68* (2018.01)
*C12Q 1/6886* (2018.01)
*A61K 31/519* (2006.01)
*A61K 31/522* (2006.01)

(52) U.S. Cl.
CPC .......... *C12Q 1/6886* (2013.01); *A61K 31/519* (2013.01); *A61K 31/522* (2013.01); *C12Q 2600/106* (2013.01); *C12Q 2600/156* (2013.01); *C12Q 2600/16* (2013.01)

(58) Field of Classification Search
None
See application file for complete search history.

(56) References Cited

FOREIGN PATENT DOCUMENTS

WO WO-2016/191525 A1 12/2016

OTHER PUBLICATIONS

Atkins et al; BJC, vol. 123, pp. 1496-1501, 2020.*
Sanchez-Vega et al; Journal of Molecular Diagnostics, vol. 4, 2002; pp. 223-229.*
Boone et al., "Targeting the Wnt/-catenin pathway in primary ovarian cancer with the porcupine inhibitor WNT974," Laboratory Investigation, vol. 96, pp. 249-259 (2016) (Published online Dec. 2015) XP055403307.
Seshagiri et al., "Recurrent R-spondin fusions in colon cancer," Nature, vol. 488, pp. 660-664 (Aug. 2012) XP055060432.
Cardona et al., Abstract 2408: "Identification of R-Spondin fusions in various types of human cancer," Cancer Res, vol. 74, No. 19 Suppl, p. 2408, Proc. AACR Ann. Mtg. Apr. 2014, Published online Oct. 2014.
Karkera et al., Abstract B03: "Identification of R-spondin fusions in NSCLC." Clin Cancer Res, (Jan. 2014) vol. 20, No. 2 Suppl. [Retrieved on Feb. 15, 2018].
Madan et al.,"Wnt addiction of genetically defined cancers reversed by PORCN inhibition," Oncogene (2016) vol. 35, No. 17, pp. 2197-2207 (Published online Aug. 2015).
Picco et al., "Loss of AXIN1 drives acquired resistance to WNT pathway blockade in colorectal cancer cells carrying RSPO3 fusions," EMBO Mol Med, (Jan. 2017) vol. 9, No. 3, pp. 293-303.
Sekine et al., "Comprehensive characterization of RSPO fusions in colorectal traditional serrated adenomas," Histopathology (May 2017) vol. 71, No. 4, pp. 601-609.
Zhang et al., "Development of a RSPO3 CLIA-validated assay as a predictive biomarker for response to anti-RSPO3 antibody treatment in patients with solid tumors," Abstract 404 (Apr. 2016) Retrieved on Feb. 15, 2018 from https://s3.amazonaws.com/posters.omed/RSPO3_CLIA_AACR2016.pdf.
Lee et al., PCR Methods and Applications, 4(5):283-87 (Apr. 1995).

* cited by examiner

*Primary Examiner* — Jehanne S Sitton
(74) *Attorney, Agent, or Firm* — Foley & Lardner LLP

(57) ABSTRACT

The present disclosure provides a multiplexed amplification reaction kit for identifying a subject suffering from a malignancy sensitive to treatment with an inhibitor of the Wnt signaling pathway, comprising a primer pair capable of amplifying a PTPRK(e13)-RSPO3(e2) R-Spondin gene-fusion. Also disclosed is a method of identifying sensitivity to an inhibitor of Wnt signaling in a subject suffering from a malignancy, comprising detecting the PTPRK(e13)-RSPO3 (e2) R-Spondin gene-fusion with a primer pair.

11 Claims, 81 Drawing Sheets

Specification includes a Sequence Listing.

C

A

B

C

A

B

A

| PTPRK plasmid (cp/µl) | Ct value (Duplicates) | | Average |
|---|---|---|---|
| | PTPRK: TxRd | | |
| 1000 | 29.76 | 29.75 | 29.76 |
| 100 | 33.53 | 33.20 | 33.37 |
| 10 | 36.28 | 36.62 | 36.45 |
| 1 | No Ct | 40.15 | 40.15 |
| NTC | No Ct | No Ct | - |

B

| PTPRK plasmid (cp/μl) | Ct value (Duplicates) | | Average |
|---|---|---|---|
| 1000 | 31.68 | 31.37 | 31.53 |
| 100 | 31.05 | 30.95 | 31.00 |
| 10 | 31.07 | 30.63 | 30.85 |
| 1 | 31.32 | 31.38 | 31.35 |
| NTC | 31.00 | 31.00 | 31.00 |

(IC77: HEX)

C

| Human Total RNA (ng/µl) | Ct value (Duplicates) | | Average |
|---|---|---|---|
| 2 | 31.27 | 31.30 | 31.29 |

PTPRK: TxRd

D

A

B

C

A

B

| Fusion A plasmid (cp/ul) | Fusion A: FAM | | | | | | |
|---|---|---|---|---|---|---|---|
| | 3plex | | | 1plex | | | ΔCt (3plex-1plex) |
| | Ct values (duplicates) | | Average | Ct values (duplicates) | | Average | |
| 1000 | 28.02 | 28.64 | 28.33 | 30.94 | 28.40 | 29.67 | -1.34 |
| 100 | 32.08 | 32.28 | 32.18 | 35.40 | 36.00 | 35.70 | -3.52 |
| 10 | 36.90 | 38.50 | 37.70 | 39.22 | 41.10 | 40.16 | -2.46 |
| 1 | 41.12 | 40.39 | 40.75 | No Ct | No Ct | - | x |
| NTC | No Ct | No Ct | - | No Ct | error | - | - |

D

| Fusion A plasmid (cp/ul) | IC77: HEX | | | | | | |
|---|---|---|---|---|---|---|---|
| | 3plex | | | 1plex | | | ΔCt |
| | Ct values (duplicates) | | Average | Ct values (duplicates) | | Average | (3plex-1plex) |
| 1000 | 31.75 | 31.25 | 31.50 | 32.29 | 30.57 | 31.43 | 0.06 |
| 100 | 31.65 | 31.82 | 31.74 | 32.18 | 32.42 | 32.30 | -0.56 |
| 10 | 31.35 | 31.52 | 31.44 | 31.67 | 31.96 | 31.81 | -0.38 |
| 1 | 31.34 | 31.75 | 31.55 | 31.57 | 31.94 | 31.76 | -0.21 |
| NTC | 31.27 | 31.04 | 31.16 | 32.22 | 32.00 | 32.11 | -0.95 |

A

B

| PTPRK plasmid (cp/μl) | PTPRK: TxRd | | | | | | |
|---|---|---|---|---|---|---|---|
| | 3plex | | | 1plex | | | ΔCt |
| | Ct values (duplicates) | | Average | Ct values (duplicates) | | Average | (3plex-1plex) |
| 1000 | 28.18 | 28.21 | 28.20 | 29.32 | 30.05 | 29.69 | -1.49 |
| 100 | 31.61 | 31.24 | 31.43 | 33.62 | 33.62 | 33.62 | -2.19 |
| 10 | 36.33 | 35.48 | 35.90 | 35.73 | 37.52 | 36.63 | -0.73 |
| 1 | 39.75 | 38.52 | 39.14 | No Ct | No Ct | - | x |
| NTC | No Ct | No Ct | - | No Ct | No Ct | - | - |

C

D

| PTPRK plasmid | IC77: HEX | | | | | ΔCt |
|---|---|---|---|---|---|---|
| | 3plex | | | 1plex | | |
| (cp/ul) | Ct values (duplicates) | | Average | Ct values (duplicates) | | Average | (3plex-1plex) |
| 1000 | 31.63 | 31.90 | 31.77 | 30.82 | 32.10 | 31.46 | 0.31 |
| 100 | 31.98 | 31.71 | 31.85 | 32.03 | 32.26 | 32.15 | -0.30 |
| 10 | 31.26 | 31.61 | 31.43 | 31.90 | 31.68 | 31.79 | -0.36 |
| 1 | 31.48 | 31.74 | 31.61 | 31.32 | 31.48 | 31.40 | 0.21 |
| NTC | 31.27 | 31.04 | 31.16 | 31.38 | 31.39 | 31.38 | -0.23 |

A

B

| RSPO3 plasmid (cp/µl) | RSPO3: Cy5 | | | | | | ΔCt |
| --- | --- | --- | --- | --- | --- | --- | --- |
| | 3plex | | | 1plex | | | |
| | Ct values (duplicates) | | Average | Ct values (duplicates) | | Average | (3plex-1plex) |
| 1000 | 27.21 | 27.68 | 27.45 | 27.86 | 28.07 | 27.97 | -0.52 |
| 100 | 31.35 | 31.36 | 31.36 | 31.07 | 30.68 | 30.88 | 0.48 |
| 10 | 33.83 | 33.56 | 33.70 | 34.39 | 33.53 | 33.96 | -0.26 |
| 1 | 36.48 | No Ct | 36.48 | No Ct | 37.43 | 37.43 | -0.95 |
| NTC | No Ct | No Ct | - | No Ct | No Ct | - | - |

C

D

| RSPO3 plasmid | IC77: HEX | | | | | | |
|---|---|---|---|---|---|---|---|
| | 3plex | | | 1plex | | | ΔCt |
| (cp/μl) | Ct values (duplicates) | | Average | Ct values (duplicates) | | Average | (3plex-1plex) |
| 1000 | 31.67 | 31.44 | 31.56 | 31.37 | 31.50 | 31.44 | 0.12 |
| 100 | 31.39 | 32.03 | 31.71 | 31.33 | 31.77 | 31.55 | 0.16 |
| 10 | 31.47 | 31.23 | 31.35 | 31.16 | 30.78 | 30.97 | 0.38 |
| 1 | 31.69 | 31.44 | 31.57 | 31.51 | 31.30 | 31.41 | 0.16 |
| NTC | 31.27 | 31.04 | 31.16 | 31.85 | 31.48 | 31.67 | -0.51 |

A

B

C

D

| Assay | Fusion A: FAM | | | PTPRK: TxRD | | | RSPO3: Cy5 | | | IC77: HEX | | |
|---|---|---|---|---|---|---|---|---|---|---|---|---|
| | Ct values (duplicates) | | Average | Ct values (duplicates) | | Average | Ct values (duplicates) | | Average | Ct values (duplicates) | | Average |
| 3plex | No Ct | No Ct | - | 31.91 | 32.03 | 31.97 | 31.13 | 31.23 | 31.18 | 31.34 | 31.51 | 31.43 |
| Fusion A/IC | No Ct | No Ct | - | | | | | | | 31.59 | 31.67 | 31.63 |
| PTPRK/IC | | | | 34.45 | 34.02 | 34.24 | | | | 32.12 | 31.64 | 31.88 |
| RSPO3/IC | | | | | | | 31.20 | 31.12 | 31.16 | 31.78 | 31.85 | 31.82 |
| ΔCt (3plex-1plex) | | | | | | -2.27 | | | 0.02 | | | |

A

B

D

| Assay | Fusion A: FAM | | | PTPRK: TxRD | | | RSPO3: Cy5 | | | IC77: HEX | | |
|---|---|---|---|---|---|---|---|---|---|---|---|---|
| | Ct values (duplicates) | | Average | Ct values (duplicates) | | Average | Ct values (duplicates) | | Average | Ct values (duplicates) | | Average |
| 3plex | 32.78 | 33.89 | 33.34 | 30.79 | 30.66 | 30.72 | 33.69 | 34.24 | 33.96 | 31.52 | 31.67 | 31.60 |
| Fusion A/IC | 35.88 | 36.72 | 36.30 | | | | | | | 31.70 | 31.75 | 31.72 |
| PTPRK/IC | | | | 32.83 | 32.43 | 32.63 | | | | 31.96 | 31.73 | 31.85 |
| RSPO3/IC | | | | | | | 34.47 | 34.36 | 34.42 | 31.31 | 31.83 | 31.57 |
| ΔCt (3plex-1plex) | | | -2.96 | | | -1.91 | | | -0.46 | | | |

A

B

| Fusion B plasmid (cp/µl) | Fusion B: FAM | | | | | | |
|---|---|---|---|---|---|---|---|
| | 3plex (smooth) | | | 1plex (circle) | | | ΔCt |
| | Ct values (duplicates) | | Average | Ct values (duplicates) | | Average | (3plex-1plex) |
| 1000 | 29.06 | 28.76 | 28.91 | 30.06 | 29.70 | 29.88 | -0.97 |
| 100 | 31.78 | 31.45 | 31.62 | 33.02 | 31.64 | 32.33 | -0.71 |
| 10 | 34.64 | 35.66 | 35.15 | 36.61 | 37.18 | 36.90 | -1.75 |
| 1 | No Ct | 40.23 | 40.23 | No Ct | No Ct | - | 40.23 |
| NTC | No Ct | No Ct | - | No Ct | No Ct | - | - |

C

D

| Fusion B plasmid (cp/μl) | 3plex (smooth) | | | 1plex (circle) | | | ΔCt (3plex-1plex) |
|---|---|---|---|---|---|---|---|
| | Ct values (duplicates) | | Average | Ct values (duplicates) | | Average | |
| 1000 | 30.61 | 30.71 | 30.66 | 31.51 | 30.77 | 31.14 | -0.48 |
| 100 | 30.90 | 30.49 | 30.70 | 31.09 | 31.14 | 31.12 | -0.42 |
| 10 | 30.45 | 30.42 | 30.44 | 30.84 | 31.02 | 30.93 | -0.49 |
| 1 | 30.66 | 30.81 | 30.74 | 31.47 | 30.91 | 31.19 | -0.45 |
| NTC | 30.41 | 30.50 | 30.46 | 31.32 | 31.65 | 31.49 | -1.03 |

IC77: HEX (table header)

A

B

| PTPRK(e7,e8) plasmid (cp/µl) | PTPRK: Cal Red 610 ||||| ΔCt |
| --- | --- | --- | --- | --- | --- | --- |
| | 3plex (smooth) || 1plex (triangle) || | (3plex-1plex) |
| | Ct values (duplicates) | Average | Ct values (duplicates) | Average | | |
| 1000 | 26.29 | 25.88 | 26.09 | 26.51 | 26.24 | 26.38 | -0.29 |
| 100 | 29.10 | 29.46 | 29.28 | 29.50 | 29.60 | 29.55 | -0.27 |
| 10 | 32.56 | 33.33 | 32.95 | 33.14 | 33.01 | 33.08 | -0.13 |
| 1 | No Ct | No Ct | - | 36.36 | No Ct | 36.08 | -36.08 |
| NTC | No Ct | No Ct | - | No Ct | No Ct | - | - |

C

D

| PTPRK(e7,e8) plasmid (cp/µl) | IC77: HEX | | | | | | ΔCt |
|---|---|---|---|---|---|---|---|
| | 3plex (smooth) | | | 1plex (triangle) | | | |
| | Ct values (duplicates) | | Average | Ct values (duplicates) | | Average | (3plex-1plex) |
| 1000 | 30.86 | 30.53 | 30.70 | 31.61 | 31.66 | 31.64 | -0.94 |
| 100 | 30.41 | 31.07 | 30.74 | 30.82 | 30.83 | 30.83 | -0.08 |
| 10 | 30.59 | 31.05 | 30.82 | 31.43 | 31.25 | 31.34 | -0.52 |
| 1 | 30.41 | 30.63 | 30.52 | 30.76 | 31.62 | 31.19 | -0.67 |
| NTC | 30.41 | 30.50 | 30.46 | 30.90 | 31.11 | 31.01 | -0.55 |

A

B

| RSPO3(e1,e2) plasmid (cp/µl) | RSPO3: Cy5 | | | | | | ΔCt |
|---|---|---|---|---|---|---|---|
| | 3plex (smooth) | | | 1plex (cross) | | | |
| | Ct values (duplicates) | | Average | Ct values (duplicates) | | Average | (3plex-1plex) |
| 1000 | 27.39 | 27.21 | 27.30 | 28.06 | 27.42 | 27.74 | -0.44 |
| 100 | 29.72 | 30.08 | 29.90 | 30.15 | 30.84 | 30.50 | -0.59 |
| 10 | 33.10 | 32.60 | 32.85 | 34.61 | 33.43 | 34.02 | -1.17 |
| 1 | No Ct | No Ct | - | 38.29 | No Ct | 38.29 | -38.29 |
| NTC | No Ct | No Ct | - | No Ct | No Ct | - | - |

C

D

| RSPO3(e1,e2) plasmid (cp/µl) | IC77: HEX | | | | | | ΔCt |
|---|---|---|---|---|---|---|---|
| | 3plex (smooth) | | | 1plex (cross) | | | |
| | Ct values (duplicates) | | Average | Ct values (duplicates) | | Average | (3plex-1plex) |
| 1000 | 31.17 | 31.10 | 31.14 | 31.31 | 30.93 | 31.12 | 0.02 |
| 100 | 30.66 | 30.54 | 30.60 | 30.53 | 30.80 | 30.67 | -0.06 |
| 10 | 30.46 | 31.10 | 30.78 | 30.85 | 31.07 | 30.96 | -0.18 |
| 1 | 30.50 | 30.39 | 30.45 | 31.11 | 30.96 | 31.04 | -0.59 |
| NTC | 30.41 | 30.50 | 30.46 | 30.47 | 30.58 | 30.53 | -0.07 |

A

B

C

D

| Assay | Fusion B: FAM | | | PTPRK: Cal Red 610 | | | RSPO3: Cy5 | | | IC77: HEX | | |
|---|---|---|---|---|---|---|---|---|---|---|---|---|
| | Ct values (duplicates) | | Average | Ct values (duplicates) | | Average | Ct values (duplicates) | | Average | Ct values (duplicates) | | Average |
| 3plex | No Ct | No Ct | - | 27.17 | 27.11 | 27.14 | 29.38 | 29.29 | 29.34 | 30.47 | 30.51 | 30.49 |
| Fusion B/IC | No Ct | No Ct | - | | | | | | | 31.26 | 31.48 | 31.37 |
| PTPRK/IC | | | | 27.48 | 27.38 | 27.43 | | | | 31.16 | 30.62 | 30.89 |
| RSPO3/IC | | | | | | | 29.99 | 29.28 | 29.64 | 30.38 | 30.57 | 30.48 |
| ΔCt (3plex-1plex) | | | | | | -0.29 | | | -0.30 | | | |

A

B

| Fusion D plasmid (cp/µl) | Ct value Set 1 (smooth) | Set 2 (triangle) | ΔCt (Set 1-Set 2) |
|---|---|---|---|
| 1000 | 30.75 | 31.15 | -0.40 |
| 100 | 30.68 | 30.99 | -0.31 |
| 10 | 30.63 | 31.21 | -0.58 |
| 1 | 30.59 | 30.72 | -0.13 |
| NTC | 30.98 | 30.82 | 0.16 |

Average ΔCt: -0.25

A

| EIF3E(e1,e2) plasmid (cp/ul) | Ct value | | ΔCt |
|---|---|---|---|
| | Set 1 (smooth) | Set 2 (triangle) | (Set 1-Set 2) |
| 1000 | 29.64 | 29.00 | 0.64 |
| 100 | 32.68 | 31.95 | 0.73 |
| 10 | 37.32 | 36.43 | 0.89 |
| 1 | No Ct | 36.13 | -36.13 |
| NTC | No Ct | No Ct | - |

Average ΔCt: 0.75
(excludes Ct for 1 cp/ul)

B

| EIF3E(e1,e2) plasmid (cp/ul) | Ct value Set 1 (smooth) | Set 2 (triangle) | ΔCt (Set 1-Set 2) |
|---|---|---|---|
| 1000 | 30.89 | 31.03 | -0.14 |
| 100 | 30.43 | 30.82 | -0.39 |
| 10 | 30.79 | 30.79 | 0.00 |
| 1 | 30.83 | 30.80 | 0.03 |
| NTC | 30.98 | 30.82 | 0.16 |

Average ΔCt: -0.07

A

B

| RSPO2(e1,e2) plasmid (cp/ul) | Ct value Set 1 (smooth) | Set 2 (triangle) | ΔCt (Set 1-Set 2) |
|---|---|---|---|
| 1000 | 30.78 | 31.20 | -0.42 |
| 100 | 30.87 | 30.98 | -0.11 |
| 10 | 31.07 | 31.09 | -0.02 |
| 1 | 31.18 | 30.49 | 0.69 |
| NTC | 30.98 | 30.82 | 0.16 |

Average ΔCt: 0.06

A

Set 1

B

| Assay | Ct value | | | |
|---|---|---|---|---|
| | Fusion D: FAM | EIF3E: TxRd | RSPO2: Cy5 | IC77: HEX |
| Set 1 (smooth) | No Ct | 26.19 | 40.24 | 31.52 |
| Set 2 (triangle) | No Ct | 25.59 | 41.82 | 31.49 |
| ΔCt (Set 1-Set 2) | - | 0.60 | -1.58 | 0.03 |

A

B

| Fusion C plasmid | Ct value | | ΔCt |
|---|---|---|---|
| | IC77: HEX | | |
| (cp/ul) | Set 1 (smooth) | Set 2 (triangle) | (Set 1-Set 2) |
| 1000 | 30.10 | 30.56 | -0.46 |
| 100 | 30.33 | 30.32 | 0.01 |
| 10 | 30.08 | 30.18 | -0.10 |
| 1 | 30.52 | 30.34 | 0.18 |
| NTC | 30.26 | 30.40 | -0.14 |

A

B

| PTPRK(e12,e13,e14)plasmid (cp/ul) | Ct value | | ΔCt |
|---|---|---|---|
| | Set 1 (smooth) | Set 2 (triangle) | (Set 1-Set 2) |
| 1000 | 31.11 | 30.40 | 0.71 |
| 100 | 30.59 | 30.46 | 0.13 |
| 10 | 30.40 | 30.73 | -0.33 |
| 1 | 30.49 | 30.29 | 0.20 |
| NTC | 30.26 | 30.40 | -0.14 |

IC77: HEX

A

B

| Assay | Ct value | | |
|---|---|---|---|
| | Fusion C: FAM | PTPRK: TxRd | IC77: HEX |
| Set 1 (smooth) | No Ct | 26.99 | 30.79 |
| Set 2 (triangle) | No Ct | 26.61 | 31.01 |
| ΔCt (Set 1-Set 2) | - | 0.38 | -0.22 |

A

B

| Assay | Ct value | | |
|---|---|---|---|
| | Fusion C: FAM | PTPRK: TxRd | IC77: HEX |
| Set 1 (smooth) | 28.53 | 24.25 | 30.37 |
| Set 2 (triangle) | 28.15 | 24.01 | 31.23 |
| ΔCt (Set 1-Set 2) | 0.38 | 0.24 | -0.86 |

A

| Fusion D: FAM |||| 
|---|---|---|---|
| Fusion D plasmid (cp/ul) | Ct value Set 1 (smooth) | Set 2 (triangle) | ΔCt (Set 1-Set 2) |
| 1000 | 28.43 | 28.06 | 0.37 |
| 100 | 31.88 | 31.60 | 0.28 |
| 10 | 35.43 | 34.25 | 1.18 |
| 1 | No Ct | No Ct | - |
| NTC | No Ct | No Ct | - |

B

| Fusion D plasmid (cp/ul) | Ct value Set 1 (smooth) | Set 2 (triangle) | ΔCt (Set 1-Set 2) |
|---|---|---|---|
| | IC77: HEX | | |
| 1000 | 31.07 | 30.98 | 0.09 |
| 100 | 31.16 | 30.57 | 0.59 |
| 10 | 30.91 | 30.12 | 0.79 |
| 1 | 30.41 | 30.24 | 0.17 |
| NTC | 30.97 | 30.46 | 0.51 |

A

| EIF3E(e1,e2) plasmid (cp/ul) | Ct value | | ΔCt |
|---|---|---|---|
| | Set 1 (smooth) | Set 2 (triangle) | (Set 1-Set 2) |
| 1000 | 29.38 | 28.63 | 0.75 |
| 100 | 33.17 | 31.75 | 1.42 |
| 10 | 35.11 | 34.32 | 0.79 |
| 1 | No Ct | 35.26 | -35.26 |
| NTC | No Ct | No Ct | - |

B

| EIF3E(e1,e2) plasmid (cp/ul) | IC77: HEX | | |
|---|---|---|---|
| | Ct value | | ΔCt |
| | Set 1 (smooth) | Set 2 (triangle) | (Set 1-Set 2) |
| 1000 | 31.03 | 30.55 | 0.48 |
| 100 | 30.65 | 30.23 | 0.42 |
| 10 | 30.75 | 30.25 | 0.50 |
| 1 | 30.60 | 30.14 | 0.46 |
| NTC | 30.97 | 30.46 | 0.51 |

A

| RSPO2-004(e1,e2) plasmid (cp/ul) | Ct value | | ΔCt |
|---|---|---|---|
| | Set 1 (smooth) | Set 2 (triangle) | (Set 1-Set 2) |
| 1000 | 27.01 | 26.44 | 0.57 |
| 100 | 30.15 | 29.76 | 0.39 |
| 10 | 32.74 | 33.36 | -0.62 |
| 1 | No Ct | No Ct | - |
| NTC | No Ct | No Ct | - |

RSPO2-004: Cy5

B

| RSPO2-004(e1,e2) plasmid (cp/ul) | Ct value Set 1 (smooth) | Set 2 (triangle) | ΔCt (Set 1-Set 2) |
|---|---|---|---|
| 1000 | 30.52 | 30.58 | -0.06 |
| 100 | 30.09 | 30.53 | -0.44 |
| 10 | 29.97 | 30.72 | -0.75 |
| 1 | 30.13 | 30.31 | -0.18 |
| NTC | 30.97 | 30.46 | 0.51 |

A

B

| Assay | Ct value | | | |
|---|---|---|---|---|
| | Fusion D: FAM | EIF3E: TxRd | RSPO2-004: Cy5 | IC77: HEX |
| Set 1 (smooth) | No Ct | 25.92 | No Ct | 30.42 |
| Set 2 (triangle) | No Ct | 25.32 | No Ct | 30.77 |
| ΔCt (Set 1-Set 2) | - | 0.60 | - | -0.35 |

A

B

| Assay | Ct value | | | |
|---|---|---|---|---|
| | Fusion D: FAM | EIF3E: TxRd | RSPO2-004: Cy5 | IC77: HEX |
| Set 1 (smooth) | No Ct | 21.92 | 35.46 | 30.71 |
| Set 2 (triangle) | No Ct | 21.39 | 38.49 | 30.83 |
| ΔCt (Set 1-Set 2) | - | 0.53 | -3.03 | -0.12 |

A

B

| Assay | Ct value | | | |
|---|---|---|---|---|
| | Fusion D: FAM | EIF3E: TxRd | RSPO2-004: Cy5 | IC77: HEX |
| Set 1 (smooth) | 28.79 | 23.33 | No Ct | 30.87 |
| Set 2 (triangle) | 28.35 | 22.71 | No Ct | 31.17 |
| ΔCt (Set 1-Set 2) | 0.44 | 0.62 | - | -0.30 |

A

B

| Assay | Ct value | | | |
|---|---|---|---|---|
| | Fusion D: FAM | EIF3E: TxRd | RSPO2-004: Cy5 | IC77: HEX |
| Set 1 (smooth) | No Ct | 22.97 | 31.62 | 30.86 |
| Set 2 (triangle) | No Ct | 22.26 | 33.02 | 31.22 |
| ΔCt (Set 1-Set 2) | - | 0.71 | -1.40 | -0.36 |

| Target | Amplicon Size (bp) |
|---|---|
| EIF3E(e1)+RSPO2(e2) | 80 |
| EIF3E | 123 |
| RSPO2-004 | 114 |
| Internal control | 77 |

KIT FOR IDENTIFYING MALIGNANCY, AND USES THEREOF

CROSS-REFERENCE TO RELATED APPLICATIONS

This application is the U.S. National Stage of International Application No. PCT/SG2017/050638, filed 21 Dec. 2017, which claims the benefit of priority of Singapore provisional application No. 10201610735P, filed on 21 Dec. 2016, and Singapore provisional application No. 10201704134V, filed on 19 May 2017, the contents of both priority applications being hereby incorporated by reference in their entirety for all purposes.

SEQUENCE LISTING

The instant application contains a Sequence Listing which has been filed electronically in ASCII format and is hereby incorporated by reference in its entirety. Said ASCII copy, created on Sep. 11, 2019, is named 117146-0105-Replacement-sequence-listing.txt and is 1,030,540 bytes in size.

FIELD OF THE INVENTION

The present invention relates to molecular biology in particular biomarkers. In particular, the present invention relates to the detection and quantification of biomarkers associated with malignancies that are sensitive or likely to be sensitive to treatment with an inhibitor of the Wnt signalling pathway.

BACKGROUND OF THE INVENTION

Cancer is the second leading cause of death worldwide, accounting for 8.2 million deaths in 2012. For decades, standard medical care has been guided by cohort-based epidemiological studies, in which the genetic variability of individuals is not accounted for, and most of the conclusions are based at the population level. Further, treatment for cancers has historically consisted of systemic cytotoxic chemotherapy. Chemotherapy has a general goal of killing cells that are growing or dividing, and chemotherapy reduces symptoms, improves quality of life, and prolongs survival in some patients with cancer. However, systemic cytotoxic chemotherapy will also kill normal, non-cancerous cells, thus resulting in numerous side effects such as hair loss, diarrhea, nausea, vomiting, blood disorders, digestive disorders and urination disorders.

The development of modern personalized medicine has been improving over the past decade. Modern personalized medicine is based on targeted therapy. In targeted cancer therapy, it is essential that information about the altered pathway and the components leading to cancer are available. The goal of personalized medicine is to use the right drug at the right dose, with minimal or no toxicity, for the right patient at the right time. An improved understanding of the molecular pathways that drive malignancy led to the development of agents that target specific molecular pathways in malignant cells beginning. The hope is that these agents will be able to preferentially kill malignant cells, but will be relatively innocuous to normal cells.

As genetic and epigenetic variations present in many forms in patients with cancer, there is an ongoing need for developing different targeted cancer therapies for different cancer patients. There is also an ongoing need for more rapid and sensitive methods of screening cancer patients and selecting the proper targeted cancer therapies for cancer patients.

SUMMARY OF THE INVENTION

In a first aspect, there is provided a multiplexed amplification reaction kit for identifying a subject suffering from a malignancy sensitive to treatment with an inhibitor of the Wnt signaling pathway comprising: a primer pair capable of amplifying a PTPRK(e13)-RSPO3(e2) R-Spondin gene-fusion, control primer pairs capable of amplifying wild type PTPRK and/or wild-type RSPO3 sequences, and/or a synthetic oligonucleotide internal control template sequence and internal control primer pair capable of amplifying the synthetic internal control template sequence.

In a second aspect, there is provided a method of detecting a PTPRK(e13)-RSPO3(e2) R-Spondin gene-fusion in a subject suffering from a malignancy, the method comprising: extracting nucleic acid from a sample from the subject; and amplifying the nucleic acid with one or more primer pairs, wherein the primer pairs are capable of amplifying a PTPRK (e13)-RSPO3(e2) gene-fusion; and detecting amplified nucleic acid.

In a third aspect, there is provided a method of identifying sensitivity to an inhibitor of Wnt signaling in a subject suffering from a malignancy comprising: extracting nucleic acid from a sample from the subject; amplifying the nucleic acid with a primer pair capable of amplifying a PTPRK (e13)-RSPO3(e2) R-Spondin gene-fusion; and identifying sensitivity to an inhibitor of Wnt signaling when a PTPRK (e13)-RSPO3(e2) R-Spondin gene-fusion is amplified.

In a fourth aspect, there is provided a method of treating a subject with a malignancy, wherein said malignancy has been identified according to the method of the second or the third aspect.

BRIEF DESCRIPTION OF THE DRAWINGS

The invention will be better understood with reference to the detailed description when considered in conjunction with the non-limiting examples and the accompanying drawings, in which:

FIG. 5 also shows the amplification plots of the internal control in samples containing the PTPRK(e1/e2) wild-type positive control plasmids (B) and in samples containing human total RNA (D). The results show that the PCR amplification reactions designed can successfully amplify the PTPRK(e1/e2) wild-type and the internal control plasmids in samples containing the PTPRK(e1/e2) wild-type positive control plasmids and in samples containing the total human RNA.

FIG. 6 also shows the amplification plots of the internal control in samples containing the RSPO3(e1/e2) wild-type positive control plasmids (B) and in samples containing human total RNA (D). The results show that the PCR amplification reactions designed can successfully amplify the RSPO3(e1/e2) wild-type and the internal control plasmids in samples containing the RSPO3(e1/e2) wild-type positive control plasmids and in samples containing the total human RNA.

FIG. 10 also shows the respective amplification plots of the single-plexed reactions of PTPRK(e1)+RSPO3(e2) fusion (B), PTPRK(e1/e2) wild-type (C), and RSPO3(e1/e2) wild-type (D). The respective Ct values are indicated below the amplification plots. The difference between the Ct value obtained using the multiplexed amplification reaction and the Ct value obtained using the single-plexed amplification reaction is denoted by $\Delta Ct$ and is also included in the table. The results show that no PTPRK(e1)+RSPO3(e2) fusion has been detected in human total RNA samples. The results also show that the multiplexed amplification reactions for the amplification of PTPRK(e1/e2) wild-type are more sensitive than the single-plexed reactions for the same target, as indicated by the negative $\Delta Ct$ value.

FIG. 11 also shows the respective amplification plots of the single-plexed reactions of PTPRK(e1)+RSPO3(e2) fusion (B), PTPRK(e1/e2) wild-type (C), and RSPO3(e1/e2) wild-type (D). The respective Ct values are indicated below the amplification plots. The difference between the Ct value obtained using the multiplexed amplification reaction and the Ct value obtained using the single-plexed amplification reaction is denoted by $\Delta Ct$ and is also included in the table. The results show that PTPRK(e1)+RSPO3(e2) fusion has been detected in CR3150 tumour RNA samples. The results also show that in general, the multiplexed amplification reactions are more sensitive than the single-plexed reactions for the same target, as indicated by the negative $\Delta Ct$ values.

FIG. 10 also shows the respective amplification plots of the single-plexed reactions of PTPRK(e7)+RSPO3(e2) fusion (B), PTPRK(e7/e8) wild-type (C), and RSPO3(e1/e2) wild-type (D). The respective Ct values are indicated below the amplification plots. The difference between the Ct value obtained using the multiplexed amplification reaction and the Ct value obtained using the single-plexed amplification reaction is denoted by ΔCt and is also included in the table. The results show that no PTPRK(e7)+RSPO3(e2) fusion has been detected in human total RNA samples. The results also show that the multiplexed amplification reactions for the amplifications of PTPRK(e7/e8) wild-type and RSPO3(e1/e2) wild-type are more sensitive than the single-plexed reactions for the same target, as indicated by the negative ΔCt values.

DETAILED DESCRIPTION OF THE PRESENT INVENTION

Figure 1:
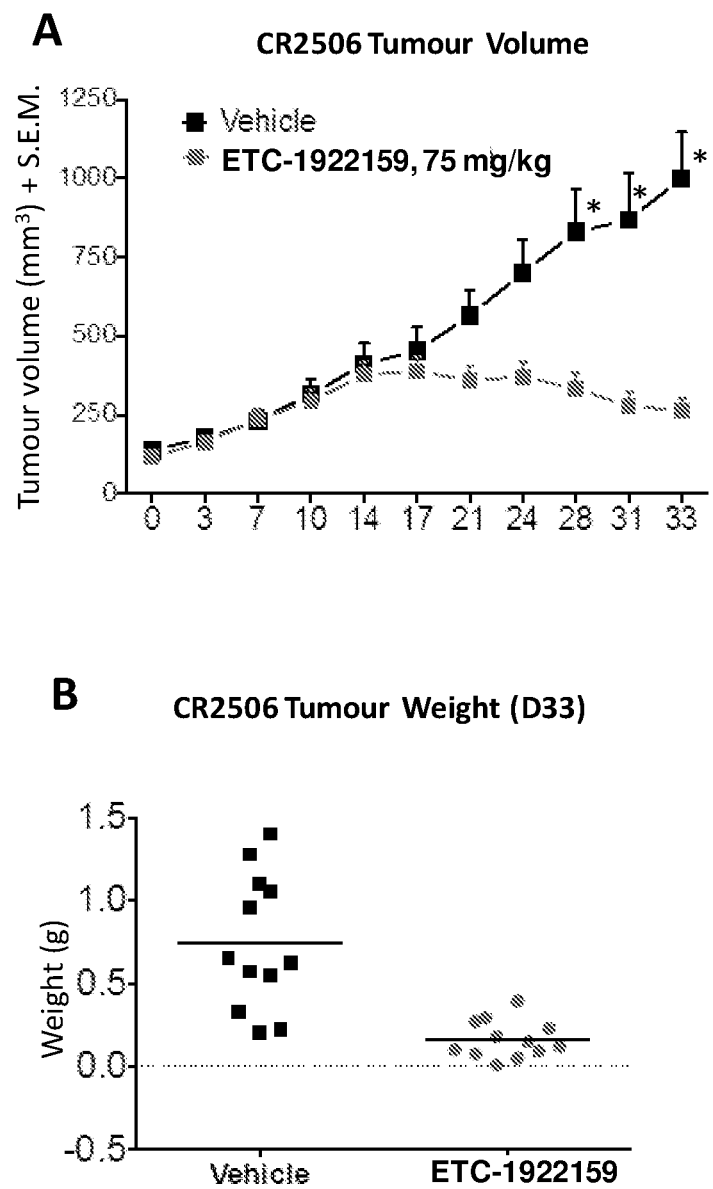
FIG. 1 shows the effect of ETC-1922159 in two different colorectal cancer patient-derived s.c. xenografts harbouring RSPO gene fusions, CR2506 and CR3150. Female Balb/c nude mice (8-10 wk) were implanted with tumour fragments in both flanks (n=6 animals/12 tumours/group). Oral daily treatment started on day 0 at an average tumour volume of 120 and 143 mm3, 35 and 22 days after implantation for (A) and (C), respectively, with tumour volume graphs showing group means from two tumours per animal (n=12); * indicates means from n=10 after the death of one animal at D24. At necropsy tumours were excised and weighed individually (B and D). Mean group body weights (n=6) are shown in E and F, or n=5 for the vehicle group marked with *. The results show that ETC-1922159 demonstrates anti-tumour efficacy in both xenografts.
Figure 1:
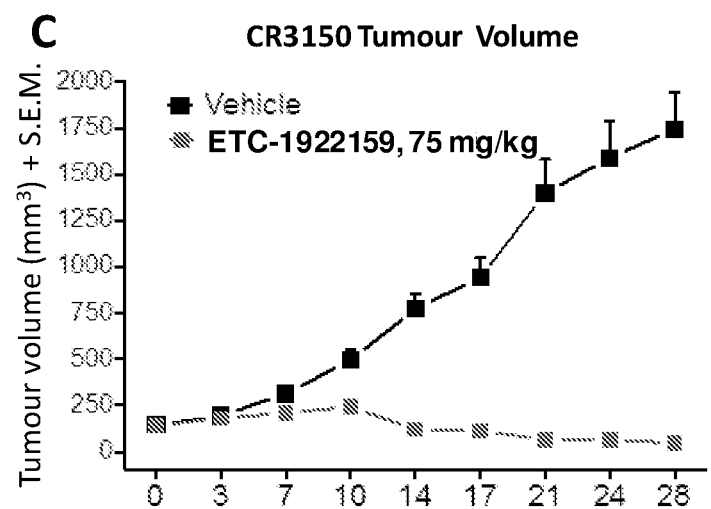
Figure 1:
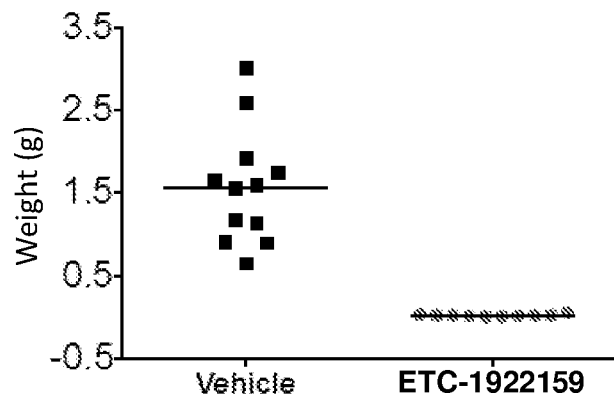
Figure 1:
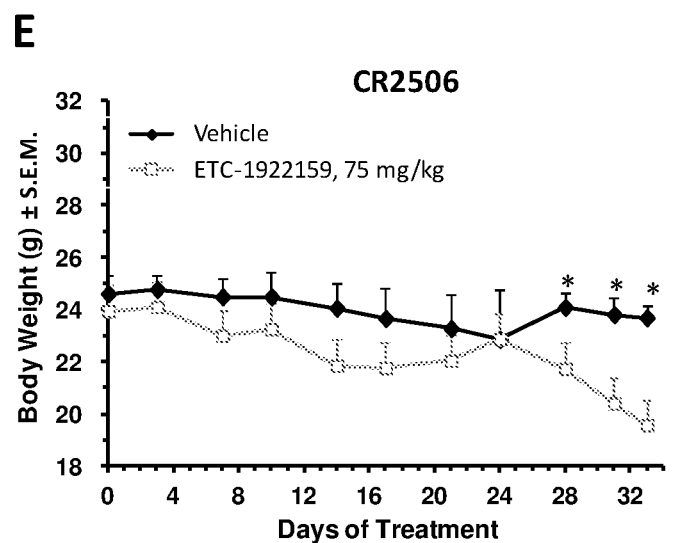
Figure 1:
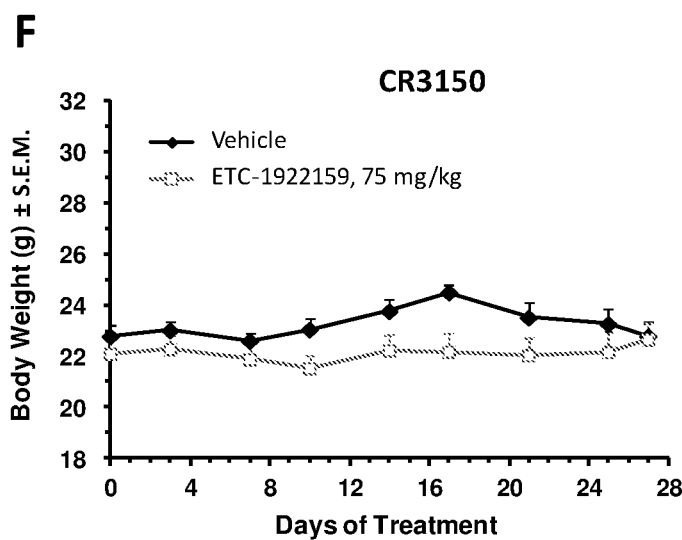
Figure 2:
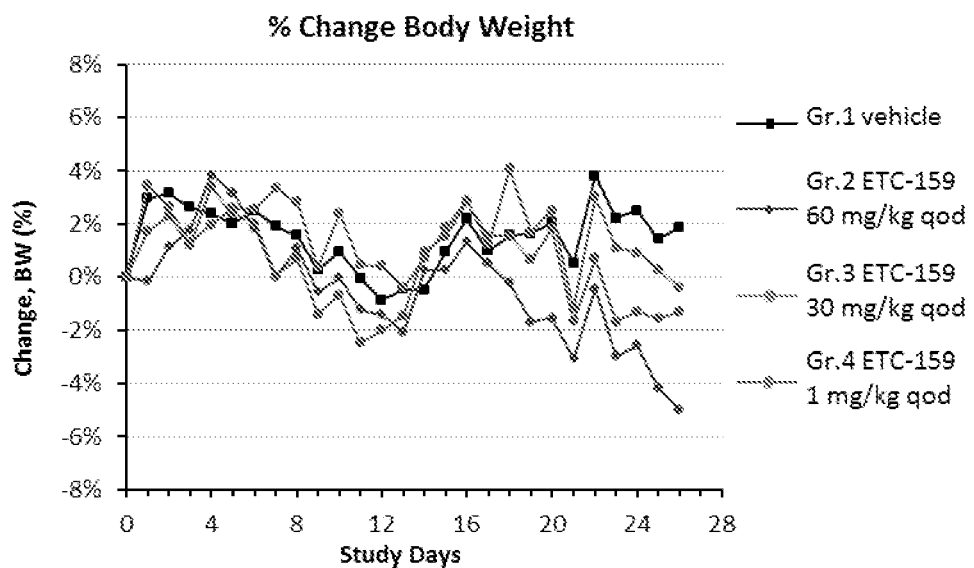
FIG. 2 shows the anti-tumor efficacy and tolerability of ETC-1922159 in the CR3150 colorectal cancer PDX model. CR3150 tumours were implanted subcutaneously into the right flank of Balb/C nude mice from fragments of a seed tumour using a trochar needle. Animals were grouped (n=12 for vehicle group, n=10 for remaining groups) and treated with either vehicle or ETC-1922159 every other day (from Day 17 onwards n=9 in Gr. 2 only). (A) shows mean body weights measured daily, and (B) shows tumour volumes measured using calipers every other day. Animals were sacrificed after the last dose and tumours and surrogate tissues for biomarker analyses were collected. All error bars show SEM. For (C), tumour wet weights were collected from only n=9 per group (animal 1-9), asterisks indicate $P<0.001$. The results show that anti-tumour efficacy and tolerability of ETC-1922159 are seen in the CR3150 colorectal cancer PDX model bearing a PTPRK-RSPO3 gene fusion.
Figure 2:
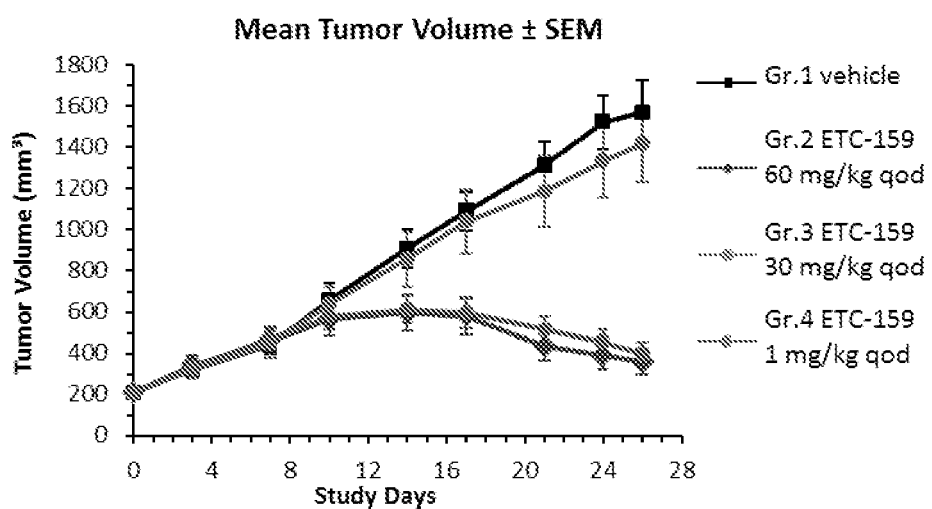
Figure 2:
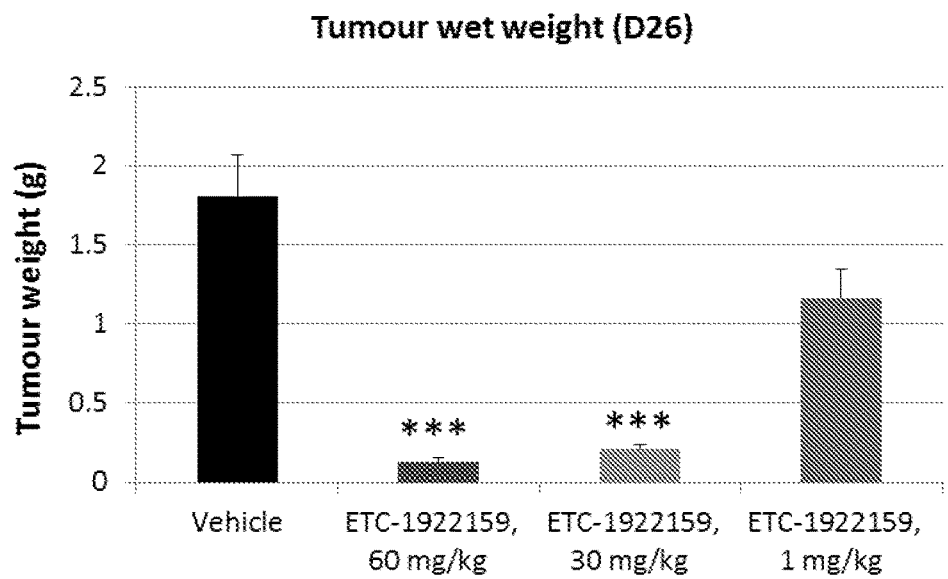
Figure 3:
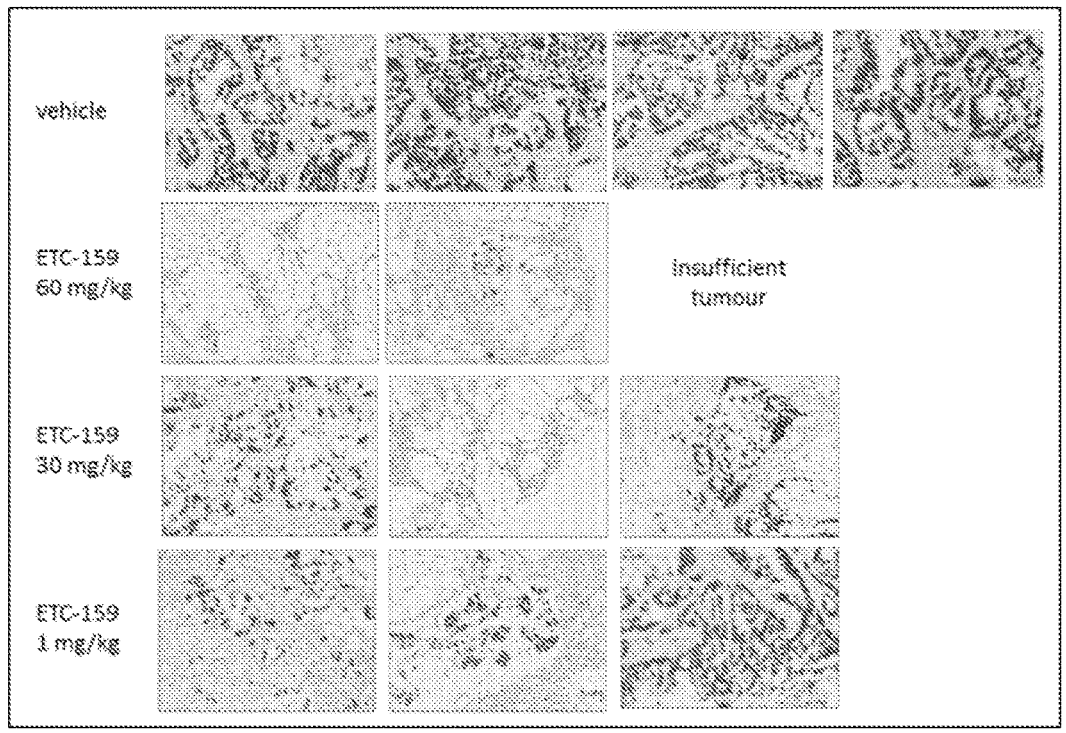
FIG. 3 shows the effect of different doses of ETC-1922159. Tumours (n=3/group) from CR3150-tumour bearing mice were harvested 24 hours after the last dose of vehicle or ETC-1922159 and FFPE-fixed. For an immunohistochemistry analysis sections were stained with the Ventana CONFIRM anti-Ki-67 (30-9) primary monoclonal antibody on the Leica BondRX autostainer. A corresponding section was stained with H&E to aid the pathologists review. Assessment of immunohistochemistry stains was performed manually and digitally by a pathologist. The determined percentage is the average of 3 low power field images. (A) shows Ki67 stain (20×) from n=3 per group. (B) shows mean % Ki67 stain, digitally counted on the left and manually assessed (C) on the right. Error bars show standard deviation. The results show that ETC-1922159 treatment inhibits tumour cell proliferation in a dose-dependent manner.
Figure 3:
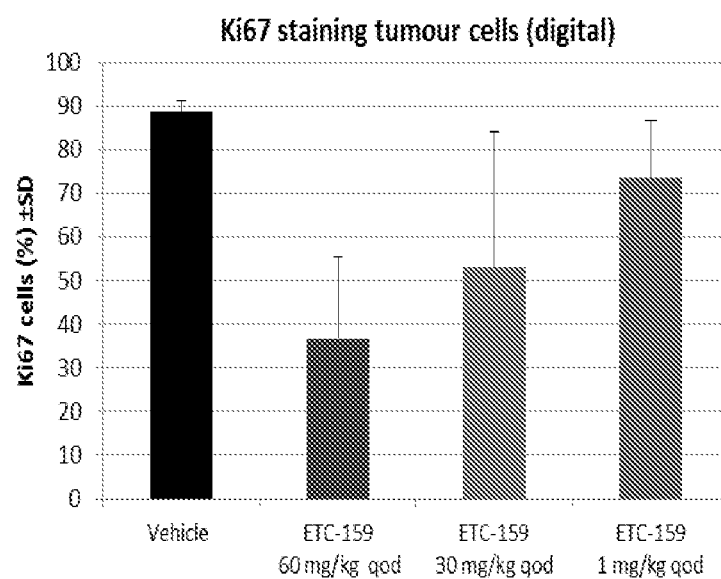
Figure 3:
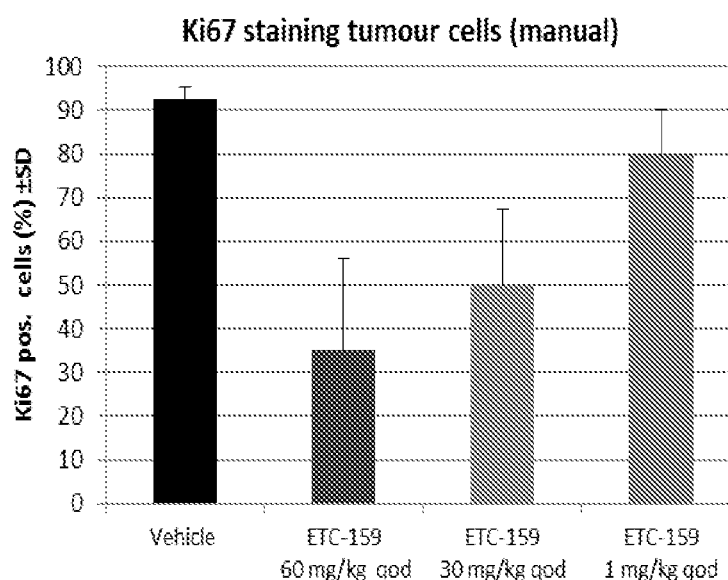

It is known that cancer patients generally react differently when given the same cancer therapy, with some patients reacting more positively than the other patients, and with some patients not reacting at all. The underlying reasons for such differences are largely not known. Thus, researchers in the field have been trying to identify the various reasons that lead to such differences in the reactions of the cancer patients, in order to provide suitable targeted cancer therapy. In the present application, the inventors found that patients with PTPRK(e13)-RSPO3(e2) R-Spondin gene-fusion can be treated more successfully with an inhibitor of the Wnt signaling pathway, as compared to patients without such gene-fusion. In another example, it was found that patients with PTPRK(e1)-RSPO3(e2) R-Spondin gene-fusion can also be treated with an inhibitor of the Wnt signaling pathway, compared to patients without such gene-fusion. Therefore, detecting PTPRK(e13)-RSPO3(e2) R-Spondin gene-fusion and/or PTPRK(e1)-RSPO3(e2) R-Spondin gene-fusion in patient samples can be useful in identifying patients suitable for the targeted therapy which uses inhibitor(s) of the Wnt signaling pathway.

In a first aspect, the present invention refers to a multiplexed amplification reaction kit for identifying a subject suffering from a malignancy sensitive to treatment with an inhibitor of the Wnt signaling pathway, comprising: a primer pair capable of amplifying (or a primer pair that amplifies) a PTPRK(e13)-RSPO3(e2) R-Spondin gene-fusion; control primer pairs capable of amplifying (or control primer pairs that amplify) wild-type PTPRK and/or wild-type RSPO3 sequences; and/or a synthetic oligonucleotide internal control template sequence and internal control primer pair capable of amplifying (or internal control primer pair that amplifies) the synthetic internal control template sequence. In another example, there is disclosed a multiplexed amplification reaction kit for identifying a subject suffering from a malignancy sensitive to treatment with an inhibitor of the Wnt signaling pathway, comprising: a primer pair capable of amplifying (or a primer pair that amplifies) a PTPRK(e1)-RSPO3(e2) R-Spondin gene-fusion; control primer pairs capable of amplifying (or control primer pairs that amplify) wild-type PTPRK and/or wild-type RSPO3 sequences; and/or a synthetic oligonucleotide internal control template sequence and internal control primer pair capable of amplifying (or internal control primer pair that amplifies) the synthetic internal control template sequence.

As used herein, the term "multiplex" or its grammatical equivalent(s) refers to the detection and/or amplification of more than one target sequence of interest in a given sample in a single amplification experiment. In one example, only one of such more than one target sequence of interest is used for the identification of a subject suffering from a malignancy sensitive to treatment with an inhibitor of the Wnt signaling pathway, with the other target sequences of interest serving as the controls. For the ease of reference, such one target sequence of interest is referred to herein as "key target sequence of interest". In a multiplex amplification experiment, multiple primer sets are typically used in the same amplification reaction to simultaneously amplify multiple target sequences of interest. By targeting multiple sequences of interest at once, additional information may be gained from a single amplification reaction that otherwise would require several times the reagents and more time to perform. In one specific embodiment, multiplex refers to the detection and/or amplification of three different target sequences in a given sample in a single amplification experiment. In another specific embodiment, multiplex refers to the detection and/or amplification of four different target sequences in a given sample in a single amplification experiment. In various other embodiments, multiplex refers to the detection and/or amplification of 2, 3, 4, 5, 6, 7, 8, 9, 10, 11, 12, 13, 14, 15, 16, 17, 18, 19, 20 or more different target sequences in a given sample in a single amplification experiment.

The term "amplification reaction" as used herein refers to a reaction that produces additional copies of a target sequence. A typical amplification reaction used in molecular biology to amplify a target sequence is a polymerase chain reaction (PCR). Examples of PCRs include but are not limited to real-time polymerase chain reaction, real-time reverse transcription polymerase chain reaction, digital polymerase chain reaction, quantitative polymerase chain reaction, qualitative polymerase chain reaction, quantitative real-time polymerase chain reaction, or quantitative reverse transcription polymerase chain reaction. In one specific example, the amplification reaction is a real-time PCR amplification reaction.

Real-time PCR monitors the amplification of a targeted DNA molecule during the PCR, i.e. in real-time, and not at its end, as in conventional PCR. Real-time PCR can be used quantitatively (Quantitative real-time PCR), and semi-quantitatively, i.e. above/below a certain amount of DNA molecules (Semi quantitative real-time PCR). Quantitative Real-Time PCR (qrt-PCR) methods use fluorescent dyes or fluorophore-containing DNA probes to measure the amount of amplified product as the amplification progresses.

Digital PCR (dPCR) simultaneously amplifies thousands of samples, each in a separate droplet within an emulsion.

Quantitative PCR (qPCR) is used to measure the specific amount of target DNA (or RNA) in a sample. By measuring amplification only within the phase of true exponential increase, the amount of measured product more accurately reflects the initial amount of target. Special thermal cyclers are used that monitor the amount of product during the amplification.

Qualitative PCR refers to a PCR method used to detect the present or absence of target DNA (RNA) in a sample without quantifying the amount present. Reverse Transcription PCR is used to reverse-transcribe and amplify RNA to cDNA. PCR is preceded by a reaction using reverse transcriptase, an enzyme that converts RNA into cDNA. The two reactions may be combined in a tube, with the initial heating step of PCR being used to inactivate the transcriptase. RT-PCR is widely used in expression profiling, which detects the expression of a gene. It can also be used to obtain sequence of an RNA transcript, which may aid the determination of the transcription start and termination sites and facilitate mapping of the location of exons and introns in a gene sequence.

In some examples, the PCR amplification involves the use of the TaqMan probe(s). TaqMan probes are hydrolysis probes that are designed to increase the specificity of quantitative PCR. The TaqMan probe principle relies on the 5'-3' exonuclease activity of Taq polymerase to cleave a dual-labeled probe during hybridization to the complementary target sequence and fluorophore-based detection. As in other quantitative PCR methods, the resulting fluorescence signal permits quantitative measurements of the accumulation of the product during the exponential stages of the PCR. The TaqMan probe significantly increases the specificity of the detection.

The term "subject" as used herein, refers to an animal, preferably a mammal, most preferably a human, who has been the object of treatment, observation or experiment. In one example the subject is not a human. The subject may for example be a non-human mammal.

The term "malignancy" as used herein refers to diseases in which abnormal cells divide without control and invade nearby tissues. Malignant diseases are commonly known as cancers. The major types of cancers that can be identified or treated by the methods or kits as described herein include but are not limited to carcinoma, sarcoma, lymphoma, germ cell tumor and blastoma. The specific types of cancers include but are not limited to lung cancer, melanoma, colorectal cancer, neuroblastoma, breast cancer, prostate cancer, renal cell cancer, transitional cell carcinoma, cholangiocarcinoma, brain cancer, non-small cell lung cancer, pancreatic cancer, gastric carcinoma, bladder cancer, esophageal cancer, mesothelioma, thyroid cancer, head and neck cancer, osteosarcoma, hepatocellular carcinoma, carcinoma of unknown primary, ovarian carcinoma, endometrial carcinoma, glioblastoma, Hodgkin lymphoma and non-Hodgkin lymphomas. In some specific examples, the malignancies to be identified or treated by the methods or kits disclosed herein are lung cancer, melanoma, colorectal cancer, lymphoma and neuroblastoma. In one example, the malignancy is a solid malignancy. In some examples, the malignancy is a gastrointestinal cancer of the esophagus, gallbladder, liver, pancreas, stomach, small intestine, large intestine, colon, rectum, or anus.

In one specific example, the malignancy is colorectal cancer. In one example, the cancer is invasive and/or metastatic cancer. In another example, the cancer is stage II cancer, stage III cancer or stage IV cancer. In another example, the cancer is an early metastatic cancer. In one example, early metastatic cancer is not necessarily an early stage cancer. In some examples, the malignancy is characterized by an elevated level of Wnt activity. An elevated level of Wnt activity can be defined by a Wnt activity that is at least 10%, or at least 20%, or at least 30%, or at least 40%, or at least 50%, or at least 60%, or at least 70%, or at least 80%, or at least 90%, or at least 100%, or at least 110%, or at least 120%, or at least 130%, or at least 140%, or at least 150%, or at least 160%, or at least 170%, or at least 180%, or at least 190%, or at least 200% than the level of Wnt activity of a subject without malignancy, or the average level of Wnt activity in subjects without malignancy in a given population. In some examples, the elevated level of Wnt activity is transcriptionally or post-transcriptionally elevated.

The term "PTPRK" as used herein refers to the PTPRK gene, which encodes for protein tyrosine phosphatase receptor type K in humans. Protein tyrosine phosphatase receptor type K is a member of the protein tyrosine phosphatase (PTP) family. Protein tyrosine phosphatase receptor type K possesses an extracellular region, a single transmembrane region, and two tandem catalytic domains, and thus represents a receptor-type PTP. The extracellular region contains a meprin-A5 antigen-PTP mu (MAM) domain, an Ig-like domain and four fibronectin type III-like repeats. PTPRK is also known as PTPkappa or PTPκ. The nucleotide sequence of the human PTPRK gene is represented by SEQ ID NO: 1, and has a total of 30 exons.

The term "PTPRK(en)" as used herein refers to exon number n of the PTPRK gene. For example, the term "PTPRK(e13) as used herein refers to exon 13 of the PTPRK gene. The nucleotide sequence of exon 13 of the human PTPRK gene is represented by SEQ ID NO: 2.

The term "RSPO3" as used herein refers to the RSPO3 gene. This gene belongs to the R-Spondin family, and encodes for the protein R-spondin-3. The nucleotide sequence of the human RSPO3 gene is represented by SEQ ID NO: 3, and has a total of 5 exons.

The term "RSPO3(em)" as used herein refers to exon number m of the RSPO3 gene. For example, the term "RSPO3(e2) as used herein refers to exon 2 of the RSPO3 gene. The nucleotide sequence of exon 2 of the human RSPO3 gene is represented by SEQ ID NO: 4.

The term "gene-fusion" as used herein refers to a hybrid gene formed from two previously separated genes. It can usually occur as a result of translocation, interstitial deletion, or chromosomal inversion. Gene-fusion is a form of mutation that plays an important role in the formation of malignancies.

The term "wild-type" as used herein in the context of a gene, refers to the most common genotype of the gene in the population of healthy individuals in the particular population. A wild-type gene is a gene that does not contain any mutation, in particular gene-fusion. A wild-type gene is used as a control in a multiplexed amplification reaction. When a target sequence of interest in a sample is a gene-fusion, for example, a A-B gene-fusion, both the wild-type gene A and the wild-type gene B or a combination thereof can be used as the control.

A primer pair capable of amplifying (or a primer pair that amplifies) a target sequence typically comprises a forward primer and a reverse primer. The primer pair capable of amplifying (or the primer pair that amplifies) a target gene-fusion typically spans the fusion site.

In one example, when the target sequence comprises a PTPRK(e13)-RSPO3(e2) R-Spondin gene-fusion, the primer pair capable of amplifying (or the primer pair that amplifies) the target sequence spans the 3' end of PTPRK (e13) and the 5' end of the RSPO3(e2). In one specific example, the primer pair comprises a forward primer targeting PTPRK(e13), and a reverse primer targeting RSPO3 (e2). In another example, the primer pair comprises a forward primer targeting PTPRK(e12/e13), and a reverse primer targeting RSPO3(e2). The nucleotide sequence of exon 12 of the human PTPRK gene is represented by SEQ ID NO: 5. One specific example of a forward primer for the target sequence PTPRK(e13)-RSPO3(e2) R-Spondin gene-fusion comprises the sequence of (5'-3') GGAGAAGGAAACTARAACCCAGT (SEQ ID NO: 6), one specific example of a reverse primer for the same target sequence comprises the sequence of (5'-3')GTCTGGGCT-TACATGACAARCATC (SEQ ID NO: 7). In one example, the forward primer for the target sequence PTPRK(e13)-RSPO3(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 6 or a complementary sequence thereof. In another example, the reverse primer for the target sequence PTPRK(e13)-RSPO3 (e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 7 or a complementary sequence thereof.

In one example, to detect the wild-type PTPRK gene, exons 12 to 14 of the PTPRK gene, represented by PTPRK (e12-e14), are used as the target sequence. The primer pair capable of amplifying (or the primer pair that amplifies) this target sequence thus spans the 3' end of PTPRK(e12), the entire PTPRK(e13), and the 5' end of PTPRK(e14). The nucleotide sequence of exon 14 of the human PTPRK gene is represented by SEQ ID NO: 8. In one specific example, the primer pair comprises a forward primer targeting PTPRK(e12), and a reverse primer targeting PTPRK(e14). In another example, the primer pair comprises a forward primer targeting PTPRK(e12/e13), and a reverse primer targeting PTPRK(e14). One specific example of a forward primer for the target sequence PTPRK(e12-e14) comprises the sequence of (5'-3')GGAGAAGGAAACT-ARAACCCAGT (SEQ ID NO: 9), one specific example of a reverse primer for the same target sequence comprises the sequence of (5'-3')GCTATTTTCACCACTCTGTCYGT (SEQ ID NO: 10). In one example, the forward primer for the target sequence PTPRK(e12-e14) has a sequence identity of at least 70%, at least 75%, at least 80%, at least 85%, at least 90%, at least 95%, at least 96%, at least 97%, at least 98% or at least 99% to the sequence of SEQ ID NO: 9 or a complementary sequence thereof. In another example, the reverse primer for the target sequence PTPRK(e12-e14) has a sequence identity of at least 70%, at least 75%, at least 80%, at least 85%, at least 90%, at least 95%, at least 96%, at least 97%, at least 98% or at least 99% to the sequence of SEQ ID NO: 10 or a complementary sequence thereof.

In one example, to detect the wild-type RSPO3 gene, exons 1 and 2 of the RSPO3 gene, represented by RSPO3 (e1/e2), are used as the target sequence. The primer pair capable of amplifying (or the primer pair that amplifies) this target sequence thus spans the 3' end of RSPO3(e1), and the 5' end of RSPO3(e2). The nucleotide sequence of exon 1 of the human RSPO3 gene is represented by SEQ ID NO: 11. In one specific example, the primer pair comprises a forward primer comprises the sequence of (5'-3') CTCYTTGGCAGCCTTGACT (SEQ ID NO: 12), and a reverse primer comprises the sequence (5'-3')AATA-CATCGGCAGCCAAAACG (SEQ ID NO: 13) or (5'-3') AATACMTYGGCAGCCAAAACG (SEQ ID NO: 14). In one example, the forward primer for the target sequence RSPO3 (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 12 or a complementary sequence thereof. In another example, the reverse primer for the target sequence RSPO3 (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 13 or SEQ ID NO: 14 or a complementary sequence thereof.

The term "internal control" as used herein refers to an internal positive control, which is a reference sequence that can be used to indicate whether the amplification system is functioning, and to distinguish true target negatives from amplification failures caused by, for example, PCR inhibition. The internal control comprises an artificial target sequence that is not found in any naturally occurring organisms.

When there is no internal control in the sample, it is not possible to differentiate true-negative and false-negative when no amplification signal is detected for the target sequence tested. When an internal control is included in the sample but is not successfully amplified, and no amplification signal is detected for the target sequence tested, it indicates that the negative amplification result is false-negative. When an internal control is included in the sample and is successfully amplified, but no amplification signal is detected for the target sequence tested, it indicates that the negative amplification result is true-negative.

In some examples, the internal control comprises a target sequence of SEQ ID NO.: 69, a complementary sequence, a fragment or a variant thereof. In some examples, the internal control primer pair capable of amplifying (or the internal control primer pair that amplifies) the internal control target sequence comprises a forward primer comprises the sequence of (5'-3')GCGCCCGAACAGTATCGCGTTT (SEQ ID NO: 16) and a reverse primer comprises the sequence of (5'-3')AGCCTCCGCTAGTCACCCAA (SEQ ID NO: 17). In one example, the forward primer for the internal control target sequence has a sequence identity of at least 70%, at least 75%, at least 80%, at least 85%, at least 90%, at least 95%, at least 96%, at least 97%, at least 98% or at least 99% to the sequence of SEQ ID NO: 16 or a complementary sequence thereof. In another example, the reverse primer for the internal control target sequence has a sequence identity of at least 70%, at least 75%, at least 80%, at least 85%, at least 90%, at least 95%, at least 96%, at least 97%, at least 98% or at least 99% to the sequence of SEQ ID NO: 17 or a complementary sequence thereof.

The kit having the components as described above is used for a multiplexed amplification reaction designed for the detection of one key target sequence of interest. The outcome of the detection of one key target sequence of interest can be used in combination with the outcome of the detection of other one or more key target sequences of interest, in order to better identify a subject suffering from a malignancy sensitive to treatment with an inhibitor of the Wnt signaling pathway, for example, by reducing the rate of false-positive or false-negative identifications. Thus, in some examples, the kit of the first aspect comprises components designed for conducting one or more additional multiplexed amplification reactions. Such one or more additional multiplexed amplification reactions are designed for the detection of one or more R-Spondin gene-fusions, for example but not limited to, PTPRK(e1)-RSPO3(e2) fusion, PTPRK(e7)-RSPO3(e2) fusion and EIF3E(e1)-RSPO2(e2) fusion. Thus, in some examples, the kit of the first aspect further comprises primer pairs capable of amplifying (or primer pairs that amplify) one or more R-Spondin gene-fusions, wherein the R-Spondin gene-fusion is a PTPRK(e1)-RSPO3(e2) fusion, a PTPRK(e7)-RSPO3(e2) fusion and a EIF3E(e1)-RSPO2 (e2) fusion; control primer pairs capable of amplifying (or control primer pairs that amplify) wild type PTPRK, wild-type EIF3E, wild-type RSPO2, and/or wild-type RSPO3 sequences; and/or synthetic oligonucleotide internal control template sequences and internal control primer pairs capable of amplifying (or internal control primer pairs that amplify) one or more synthetic internal control template sequences. In preferred examples, the one or more multiplexed amplification reactions are conducted separately in order to minimize interactions between multiplexed amplification reactions. However, with the proper use of probes with different detectable labels, one or more of the multiplexed amplification reactions can be combined into one reaction.

The term "PTPRK(e1)" as used herein refers to exon 1 of the PTPRK gene. The nucleotide sequence of exon 1 of the human PTPRK gene is represented by SEQ ID NO: 18. A primer pair capable of amplifying (or a primer pair that amplifies) the PTPRK(e1)-RSPO3(e2) fusion spans the 3' end of PTPRK(e1) and the 5' end of the RSPO3(e2). In one specific example, the primer pair comprises a forward primer targeting PTPRK(e1), and a reverse primer targeting RSPO3(e2). One specific example of a forward primer for the target sequence PTPRK(e1)-RSPO3(e2) R-Spondin gene-fusion comprises the sequence of (5'-3')CT-SYTTTTGTGGCGYTCT (SEQ ID NO: 19), one specific example of a reverse primer for the same target sequence comprises the sequence of (5'-3')CT-CYTTGGCAGCCTTGACT (SEQ ID NO: 20). In one example, the forward primer for the target sequence PTPRK (e1)-RSPO3(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 19 or a complementary sequence thereof. In another example, the reverse primer for the target sequence PTPRK (e1)-RSPO3(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 20 or a complementary sequence thereof.

For the multiplexed amplification reaction designed for the detection of the key target sequence of interest PTPRK (e1)-RSPO3(e2) fusion, to detect the wild-type PTPRK gene, exons 1 and 2 of the PTPRK gene, represented by PTPRK (e1/e2), are used as the target sequence. The nucleotide sequence of exon 2 of the human PTPRK gene is represented by SEQ ID NO: 21. The primer pair capable of amplifying (or the primer pair that amplifies) this target sequence thus spans the 3' end of PTPRK(e1) and the 5' end of PTPRK(e2). In one specific example, the primer pair comprises a forward primer targeting PTPRK(e1), and a reverse primer targeting PTPRK(e2). One specific example of a forward primer for the target sequence PTPRK(e1/e2) comprises the sequence of (5'-3')CT-SYTTTTGTGGCGYTCT (SEQ ID NO: 22), specific examples of a reverse primer for the same target sequence comprises the sequence of (5'-3')CCTGGTGGTAAT-CACAGGS (SEQ ID NO: 23) or (5'-3')CCTGGTGGTAAT-CACAGGC (SEQ ID NO: 24). In one example, the forward primer for the target sequence PTPRK (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 22 or a complementary sequence thereof. In another example, the reverse primer for the target sequence PTPRK (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 23 or SEQ ID NO: 24, or a complementary sequence thereof.

For the multiplexed amplification reaction designed for the detection of the key target sequence of interest PTPRK (e1)-RSPO3(e2) fusion, to detect the wild-type RSPO3 gene, RSPO3 (e1/e2) are used as the target sequence. Exemplary primers used for the detection of RSPO3 (e1/e2) are described above.

The term "PTPRK(e7)" as used herein refers to exon 7 of the PTPRK gene. The nucleotide sequence of exon 7 of the human PTPRK gene is represented by SEQ ID NO: 25. A primer pair capable of amplifying (or a primer pair that amplifies) the PTPRK(e7)-RSPO3(e2) fusion spans the 3' end of PTPRK(e7) and the 5' end of the RSPO3(e2). In one specific example, the primer pair comprises a forward primer targeting PTPRK(e7), and a reverse primer targeting RSPO3(e2). One specific example of a forward primer for the target sequence PTPRK(e7)-RSPO3(e2) R-Spondin gene-fusion comprises the sequence of (5'-3') ATCCGAGTTCTRCTTACAAGACCT (SEQ ID NO: 26), one specific example of a reverse primer for the same target sequence comprises the sequence of (5'-3')CT-CYTTGGCAGCCTTGACT (SEQ ID NO: 27). In one example, the forward primer for the target sequence PTPRK (e7)-RSPO3(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 26 or a complementary sequence thereof. In another example, the reverse primer for the target sequence PTPRK (e7)-RSPO3(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 27 or a complementary sequence thereof.

For the multiplexed amplification reaction designed for the detection of the key target sequence of interest PTPRK (e7)-RSPO3(e2) fusion, to detect the wild-type PTPRK gene, exons 7 and 8 of the PTPRK gene, represented by PTPRK (e7/e8), are used as the target sequence. The nucleotide sequence of exon 8 of the human PTPRK gene is represented by SEQ ID NO: 28. The primer pair capable of amplifying (or the primer pair that amplifies) this target sequence thus spans the 3' end of PTPRK(e7) and the 5' end of PTPRK(e8). In one specific example, the primer pair comprises a forward primer targeting PTPRK(e7), and a reverse primer targeting PTPRK(e8). One specific example of a forward primer for the target sequence PTPRK(e7/e8) comprises the sequence of (5'-3')ATCCGAGTTCTRCTTA-CAAGACCT (SEQ ID NO: 29), specific examples of a reverse primer for the same target sequence comprises the sequence of (5'-3')CCGTCTTGCCTGTATTTSAGC (SEQ ID NO: 30). In one example, the forward primer for the target sequence PTPRK (e7/e8) has a sequence identity of at least 70%, at least 75%, at least 80%, at least 85%, at least 90%, at least 95%, at least 96%, at least 97%, at least 98% or at least 99% to the sequence of SEQ ID NO: 29 or a complementary sequence thereof. In another example, the reverse primer for the target sequence PTPRK (e7/e8) has a sequence identity of at least 70%, at least 75%, at least 80%, at least 85%, at least 90%, at least 95%, at least 96%, at least 97%, at least 98% or at least 99% to the sequence of SEQ ID NO: 30, or a complementary sequence thereof.

For the multiplexed amplification reaction designed for the detection of the key target sequence of interest PTPRK (e7)-RSPO3(e2) fusion, to detect the wild-type RSPO3 gene, RSPO3 (e1/e2) are used as the target sequence. Exemplary primers used for the detection of RSPO3 (e1/e2) are described above.

The term "EIF3E" as used herein refers to the EIF3E gene, which encodes for Eukaryotic Translation Initiation Factor 3 (short form eIF3) Subunit E, a subunit of the eIF3 complex, which is a complex that stimulates translation initiation. In humans, eIF3 consists of 13 nonidentical subunits (eIF3a-m). The nucleotide sequence of the human EIF3E gene is represented by SEQ ID NO: 31, and has a total of 13 exons.

The term "EIF3E (ep)" as used herein refers to exon number p of the EIF3E gene. For example, the term "EIF3E (e1) as used herein refers to exon 1 of the EIF3E gene. The nucleotide sequence of exon 1 of the human EIF3E gene is represented by SEQ ID NO: 32.

The term "RSPO2" as used herein refers to the RSPO2 gene. This gene belongs to the R-Spondin family, and encodes for the protein R-spondin-2. The nucleotide sequence of the human RSPO2 gene is represented by SEQ ID NO: 33, and has a total of 3 exons.

The term "RSPO2(eq)" as used herein refers to exon number q of the RSPO2 gene. For example, the term "RSPO3(e2) as used herein refers to exon 2 of the RSPO2 gene. The nucleotide sequence of exon 2 of the human RSPO2 gene is represented by SEQ ID NO: 34.

A primer pair capable of amplifying (or a primer pair that amplifies) the EIF3E(e1)-RSPO2(e2) fusion spans the 3' end of EIF3E(e1) and the 5' end of the RSPO2(e2). In one specific example, the primer pair comprises a forward primer targeting EIF3E(e1), and a reverse primer targeting RSPO2(e2). One specific example of a forward primer for the target sequence EIF3E(e1)-RSPO2(e2) R-Spondin gene-fusion comprises the sequence of (5'-3')TCGG-CATCTAGTCTTTCCGCTTYGGAGAAGGAAACT-ARAACC CAGT (SEQ ID NO: 35), another example of a forward primer for the target sequence EIF3E(e1)-RSPO2 (e2) R-Spondin gene-fusion comprises the sequence of (5'-3')TCGGCATCTAGTCTTTCCGCTTY (SEQ ID NO: 36), one specific example of a reverse primer for the same target sequence comprises the sequence of (5'-3') AGTTCAGCGCGATCAGCA (SEQ ID NO: 37). In one example, the forward primer for the target sequence EIF3E (e1)-RSPO2(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 35 or 36 or a complementary sequence thereof. In another example, the reverse primer for the target sequence EIF3E (e1)-RSPO2(e2) R-Spondin gene-fusion has a sequence identity of at least 70%, at least 75%, at least 80%, at least 85%, at least 90%, at least 95%, at least 96%, at least 97%, at least 98% or at least 99% to the sequence of SEQ ID NO: 37 or a complementary sequence thereof.

In one example, to detect the wild-type EIF3E gene, exons 1 and 2 of the EIF3E gene, represented by EIF3E(e1/e2), are used as the target sequence. The primer pair capable of amplifying (or the primer pair that amplifies) this target sequence thus spans the 3' end of EIF3E(e1) and the 5' end of EIF3E(e2). The nucleotide sequence of exon 2 of the human EIF3E gene is represented by SEQ ID NO: 38. In one specific example, the primer pair comprises a forward primer targeting EIF3E(e1), and a reverse primer targeting EIF3E(e2). One specific example of a forward primer for the target sequence EIF3E(e1/e2) comprises the sequence of (5'-3')GCATCTAGTCTTTCCGCTT (SEQ ID NO: 39), one specific example of a reverse primer for the same target sequence comprises the sequence of (5'-3')ACATCCAT-AGCAAAGTCTACC (SEQ ID NO: 40). In one example, the forward primer for the target sequence EIF3E(e1/e2) has a sequence identity of at least 70%, at least 75%, at least 80%, at least 85%, at least 90%, at least 95%, at least 96%, at least 97%, at least 98% or at least 99% to the sequence of SEQ ID NO: 39 or a complementary sequence thereof. In another example, the reverse primer for the target sequence EIF3E(e1/e2) has a sequence identity of at least 70%, at least 75%, at least 80%, at least 85%, at least 90%, at least 95%, at least 96%, at least 97%, at least 98% or at least 99% to the sequence of SEQ ID NO: 40 or a complementary sequence thereof.

In one example, to detect the wild-type RSPO2 gene, exons 1 and 2 of the RSPO2 gene, represented by RSPO2 (e1/e2), are used as the target sequence. The primer pair capable of amplifying (or the primer pair that amplifies) this target sequence thus spans the 3' end of RSPO2(e1), and the 5' end of RSPO2(e2). The nucleotide sequence of exon 1 of the human RSPO2 gene is represented by SEQ ID NO: 41. In one specific example, the primer pair comprises a forward primer comprises the sequence of (5'-3')ACGTGCTAAC-CAAGCGGCTC (SEQ ID NO: 42) or (5'-3') TTCTGCCTTCTACAGCTCGGA (SEQ ID NO: 43), and a reverse primer comprises the sequence of (5'-3') TTCAGCGCGATCAGCATCTCT (SEQ ID NO: 44) or (5'-3')AGTTCAGCGCGATCAGCA (SEQ ID NO: 45). In one example, the forward primer for the target sequence RSPO2 (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 42 or 43 or a complementary sequence thereof. In another example, the reverse primer for the target sequence RSPO2 (e1/e2) has a sequence identity of at least 70%, at least 75%, at least 80%, at least 85%, at least 90%, at least 95%, at least 96%, at least 97%, at least 98% or at least 99% to the sequence of SEQ ID NO: 44 or 45 or a complementary sequence thereof.

In some examples, the internal controls used in the one or more multiplexed amplification reactions are the same, and therefore, the internal control primer pairs capable of amplifying (or the internal control primer pairs that amplify) the internal controls are also the same. Different internal controls and their respectively primer pairs could be designed using known methods. A person skilled in the art may appreciate and understand that the requisite internal controls may be constructed by said person skilled in the art based on the information and knowledge available in the art. In one example, an internal control sequence has been provided as SEQ ID NO: 69.

Other than using the suitable primer(s), the amplification of the target sequence can further comprise the use of a probe capable of binding (or a probe that binds) to the target sequence.

In some example, the kit of the first aspect further comprises one or more probe sequences complementary to a sequence in the one or more R-Spondin gene-fusions, the one or more wild type genes, or the one or more internal control sequences.

In one example, the probe used comprises a component which comprises at least one detectable label. In one example, the detectable label is capable of producing an optical signal. In one example, the detectable label comprises a fluorophore moiety. Examples of fluorophores include but are not limited to fluorescent proteins, for example GFP (green fluorescent protein), YFP (yellow fluorescent protein), RFP (red fluorescent protein); non-protein fluorophores selected from the group consisting of xanthene derivatives (for example, fluorescein, rhodamine, Oregon green, eosin, 6-carboxyfluorescein and Texas red); cyanine derivatives (for example, cyanine, indocarbocyanine, oxacarbocyanine, thiacarbocyanine, and merocyanine), squaraine derivatives and ring-substituted squaraines, including Seta, SeTau, and Square dyes, naphthalene derivatives (dansyl and prodan derivatives), coumarin derivatives, oxadiazole derivatives (for example pyridyloxazole, nitrobenzoxadiazole and benzoxadiazole), anthracene derivatives (for example anthraquinones, DRAQ5, DRAQ7 and CyTRAK Orange), pyrene derivatives (for example cascade blue), oxazine derivatives (for example, Nile red, Nile blue, cresyl violet, oxazine 170), acridine derivatives (for example proflavin, acridine orange, acridine yellow), arylmethine derivatives (for example auramine, crystal violet, malachite green), tetrapyrrole derivatives (for example porphin, phthalocyanine, bilirubin) and derivatives thereof. In some examples, the fluorophore is FAM (carboxyfluorescein), HEX (carboxy-2,4,4,5,7,7-hexachlorofluorescein succinimidyl ester), JOE (6-Carboxy-4',5'-Dichloro-2',7'-Dimethoxyfluorescein, Succinimidyl Ester), Cyanine3, Cyanine5, TAMRA (5-(and -6)-Carboxytetramethylrhodamine, Succinimidyl Ester), Tye 563, Tye 556, TEX 615, LCRED640, Texas red (sulforhodamine 101 acid chloride) or Cal Red 610. In some specific examples, the fluorophore is FAM, Cyanine5, Texas red, Cal Red 610 or HEX.

In a multiplexed amplification reaction for the detection of multiple target sequences, typically different detectable labels are used for the deferent target sequences. For example, detectable label A is used for the key target sequence A, detectable label B is used for a wild-type control B, detectable label C is used for a wild-type control C, and detectable label D is used for a wild-type control D. In preferred examples, the emission wavelengths of the different detectable labels are well separated so as to minimize interference. For example, the difference between each emission wavelength is at least 30 nm, or at least 40 nm, or at least 50 nm, or at least 60 nm, or at least 70 nm, or at least 80 nm, or at least 90 nm, or at least 100 nm, or at least 110 nm, or at least 120 nm, or at least 130 nm, or at least 140 nm, or at least 150 nm, or at least 160 nm, or at least 170 nm, or at least 180 nm, or at least 190 nm, or at least 200 nm, or at least 210 nm, or at least 220 nm, or at least 230 nm, or at least 240 nm, or at least 250 nm, or at least 260 nm, or at least 270 nm, or at least 280 nm, or at least 290 nm, or at least 300 nm. In some specific examples, the fluorophore used in the probe for the key target sequence is FAM (carboxyfluorescein), the fluorophore used in the probe for a wild-type control is Texas red (sulforhodamine 101 acid chloride), the fluorophore used in the probe for another wild-type control is Cyanine5, and the fluorophore used in the probe for the internal control is HEX (carboxy-2,4,4,5, 7,7-hexachlorofluorescein succinimidyl ester).

In one example, the at least one detectable label is capable of producing a changeable signal. The changeable signal may be produced upon the hybridization of the probe to the target sequence. For example, the signal may be detectable before the probe binds to the target sequence, and upon the hybridization of the probe to the target sequence, the signal is reduced in strength or becomes completely undetectable. In another example, the detectable signal may be produced only upon the hybridization of the probe to the target sequence, or the strength of the detectable signal may be increased upon the hybridization of the probe to the target sequence.

In one example, the component comprises two detectable labels. In one example, the two detectable labels function independently, while in another example, the two detectable labels are an interactive pair of labels. The interactive pair of labels are capable of generating a changeable signal. For example, the signal may be detectable before the probe binds to the target sequence, and upon the hybridization of the probe to the target sequence, the signal is reduced in strength or becomes completely undetectable. In another example, the detectable signal may be produced only upon the hybridization of the probe to the target sequence, or the strength of the detectable signal may be increased upon the hybridization of the probe to the target sequence. In one specific example, the detectable signal is not generated when both detectable labels are linked together by the probe sequence. Once at least one detectable label is cleaved from the probe, the detectable signal is generated.

In some examples, the interactive pair of labels may comprise a fluorophore and a quencher pair. In one specific example, the fluorophore is located at the 5' end of the probe, and the quencher is located at the 3' end of the probe. Examples of quenchers include but are not limited to TAMRA (tetramethylrhodamine), TaqMan® MGB (minor groove binder) and BHQ™ (Black Hole Quencher™).

Some specific exemplary probe sequences that can be used in the multiplexed amplification reactions include but are not limited to: (6FAM)5'-CCAGYTCYCCKCAGTG-CATCCT-3'(BHQ1) (SEQ ID NO: 46) for the PTPRK(e1)-RSPO3(e2) fusion, (TxRd)5'-AAGTACAGCCACCTGCG-GAGA-3'(BHQ2) (SEQ ID NO: 47) or (TxRd)5'-AAGTAYAGCCAYCTGMGGAGA-3'(BHQ2) (SEQ ID NO: 48) for the PTPRK (e1/e2) wild-type control, (Cy5)5'-TGCATTCTTCGCTGGCGCCTT-3'(BHQ2) (SEQ ID NO: 49) for the RSPO3 (e1/e2) wild-type control, (HEX)5'-AGGTCGGGTGGGCGGGTCGTTA-3'(BHQ1) (SEQ ID NO: 50) for the internal control, (6FAM)5'-ACCAGAASAAAATGTGCAGTGCATCC-3'(BHQ1) (SEQ ID NO: 51) for the PTPRK(e7)-RSPO3 (e2) fusion, (TxRd)5'-ATGTGCMGAACCTATGAGAACCCCAA-3' (BHQ2) (SEQ ID NO: 52) for the PTPRK (e7/e8) wild-type control, (6FAM)5'-AYGCATTGCTACAAAAGTG-CATCCTA-3'(BHQ1) (SEQ ID NO: 53) or (6FAM)5'-ACT-AACGTTAGGATGCAMTTTTGTAGCAATG-3'(BHQ1) (SEQ ID NO: 54) for the PTPRK(e13)-RSPO3 (e2) fusion, (TxRd)5'-AYCCCAGATCCCGCCAAGCA-3'(BHQ2) (SEQ ID NO: 55) for the PTPRK (e12-e14) wild-type control, (6FAM)5'-SCGCCACGAACCTCCTTTA-CAGAG-3'(BHQ1) (SEQ ID NO: 56) for the EIF3E(e1)-RSPO2(e2) fusion, (TxRd)5'-ATTGGARCTTCTTAGTGA-TACCAACA-3'(BHQ2) (SEQ ID NO: 57) for the EIF3E (e1/e2) wild-type control, and (Cy5)5'-CTCCCTAGGCGCSGTGCTCCATC-3'(BHQ2) (SEQ ID NO: 58) or (Cy5)5'-CCACGAACCAATTGTRT-CGCTTCCTG-3'(BHQ2) (SEQ ID NO: 59) for the RSPO2 (e1/e2) wild-type control.

In some examples, the kit of the first aspect further comprises one or more positive controls, each for the gene-fusion of interest and the wild-type control(s). Each positive control generally comprises a plasmid containing a single long oligonucleotide corresponding to the target sequence of interest. During each multiplexed amplification reaction, a suitable positive control reaction is set up along with the test reaction in order to ensure that the amplification reaction is functioning.

Figure 31:
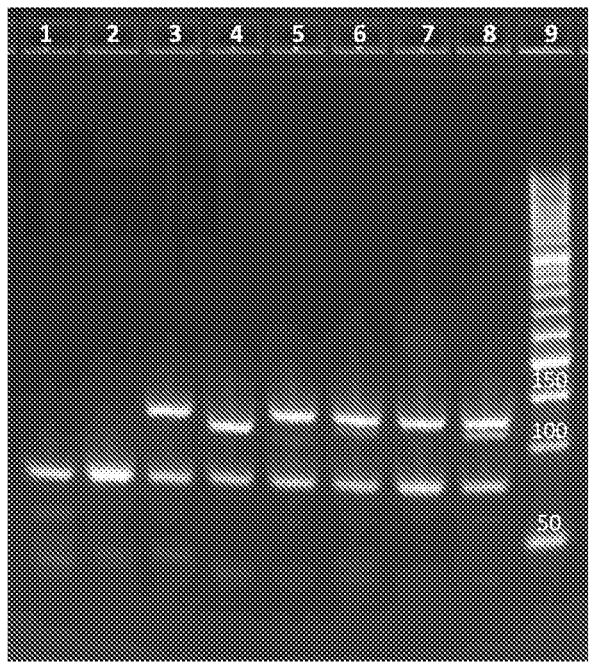
FIG. 31 shows the gel electrophoresis of the PCR products obtained. The amplicon sizes of the targets are also included in FIG. 5. The following samples are used in lanes 1-8—Lane 1: no template control; Land 2: EIF3E(e1)+RSPO2(e2) positive control plasmid; Lane 3: EIF3E(e1/e2) wild-type control plasmid; Lane 4: RSPO2 (e1/e2) wild-type control plasmid; Lane 5: human total RNA; Lane 6: CR205 RNA; Lane 7: CR210 RNA; Lane 8: CR214 RNA.
Figure 32:
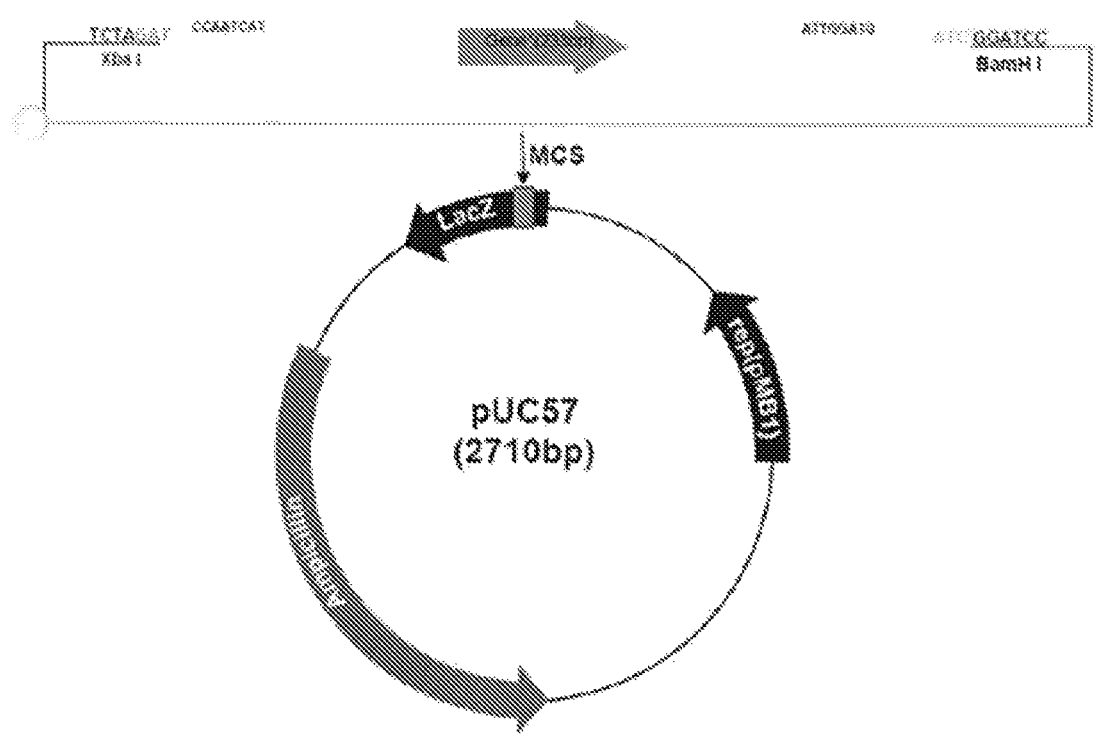
FIG. 32 shows a schematic of the plasmid map of the pUC57 vector used in the present application.

The corresponding plasmid map can be found in FIG. 31, and the insert sequences can be found at SEQ ID NOS. 59 to 68.

The primers and probes of the kit of the first aspect are designed for the amplification and detection of short amplicon(s). A short amplicon refers to an amplicon of, for example, less than about 300 base pairs, less than about 290 base pairs, less than about 280 base pairs, less than about 270 base pairs, less than about 260 base pairs, less than about 250 base pairs, less than about 240 base pairs, less than about 230 base pairs, less than about 220 base pairs, less than about 210 base pairs, less than about 200 base pairs, less than about 190 base pairs, less than about 180 base pairs, less than about 170 base pairs, less than about 160 base pairs, less than about 150 base pairs, less than about 140 base pairs, less than about 130 base pairs, less than about 120 base pairs, less than about 110 base pairs, less than about 100 base pairs, less than about 90 base pairs, less than about 80 base pairs, less than about 70 base pairs, less than about 60 base pairs, or less than about 50 base pairs. Specific examples of short amplicons have less than 150 base pairs, less than 140 base pair, less than 130 base pair, less than 120 base pairs, less than 110 base pairs, or less than 100 base pairs. In one specific example, a short amplicon is less than 130 base pairs.

In some examples, the kit of the first aspect further comprises reagents for performing polymerase chain reaction. Such reagents include but are not limited to deoxyribonucleotides (dNTPs), DNA polymerase, salt and buffer. DNA polymerases catalyze the addition of dNTPs to an elongating DNA strand by adding bases complementary to the template strand.

In a second aspect, there is provided a method of detecting a PTPRK(e13)-RSPO3(e2) R-Spondin gene-fusion in a subject suffering from a malignancy, the method comprising: extracting nucleic acid from a sample from the subject; and amplifying the nucleic acid with one or more primer pairs, wherein the primer pairs are capable of amplifying a PTPRK (e13)-RSPO3(e2) gene-fusion; and detecting amplified nucleic acid. In some example, the method of the second aspect further comprises amplifying the nucleic acid with one or more primer pairs capable of amplifying (or one or more primer pairs that amplify) a PTPRK(e1)-RSPO3(e2) fusion, a PTPRK(e7)-RSPO3(e2) fusion, and/or a EIF3E (e1)-RSPO2(e2) fusion.

In a third aspect, there is provided a method of identifying sensitivity to an inhibitor of Wnt signaling in a subject suffering from a malignancy comprising: extracting nucleic acid from a sample from the subject; amplifying the nucleic acid with a primer pair capable of amplifying (or a primer pair that amplifies) a PTPRK(e13)-RSPO3(e2) R-Spondin gene-fusion; and identifying sensitivity to an inhibitor of Wnt signaling when a PTPRK(e13)-RSPO3(e2) R-Spondin gene-fusion is amplified. In some examples, the method of the third aspect further comprises amplifying the nucleic acid with one or more additional primer pairs capable of amplifying (or one or more additional primer pairs that amplify) a PTPRK(e1)-RSPO3(e2) fusion, a PTPRK(e7)-RSPO3(e2) fusion, or a EIF3E(e1)-RSPO2(e2) fusion; and identifying sensitivity to an inhibitor of Wnt signaling when a PTPRK(e1)-RSPO3(e2) fusion, a PTPRK(e7)-RSPO3(e2) fusion, a PTPRK(e13)-RSPO3(e2) fusion, or a EIF3E(e1)-RSPO2(e2) fusion is amplified.

The primers and primer pairs capable of amplifying (or the primers and primer pairs that amplify) a PTPRK(e13)-RSPO3(e2) R-Spondin gene-fusion, a PTPRK(e1)-RSPO3 (e2) fusion, a PTPRK(e7)-RSPO3(e2) fusion, and/or a EIF3E(e1)-RSPO2(e2) fusion are as described in the present disclosure.

For each multiplexed amplification experiment, at least the following reactions (and replicates thereof) are set up: a positive control reaction for each of the gene-fusion and wild-type control(s), a negative control reaction, and a test reaction. All reactions contain the same reagents, primers and/or probes, with the only difference being the sample added in each reaction. The sample added in a positive control reaction is a positive control for the target gene-fusion or wild-type sequence as defined above. The sample added in a negative control does not contain any template. A typical sample added in a negative control is nuclease-free water. The sample added in a test reaction is a biological sample obtained from a subject of interest. In one example, the Fusion A is run as 3-plex (for example, fusion A and 2 WT). In another example, the Fusion B is run as a 2-plex (for example, fusion B and WT). In yet another example, the fusion C is run as a 2-plex (for example, fusion C and WT). In another example, the fusion C is run as a 2-plex (for example, fusion C+WT PTPRK). In a further example, the fusion D is run as a 3-plex (for example, fusion D and WT). In yet another example, the fusion D is run as a 3-plex (for example, fusion D and WT EIF3E and WT RSPO2).

In one example, the biological sample comprises at least some biological materials such as nucleic acid molecules, in particular ribonucleic acids (RNAs). In some examples, the biological samples comprise RNAs obtained from solid tissue samples or liquid samples (such as whole blood, blood serum, blood plasma, cerebrospinal fluid, central spinal fluid, lymph fluid, cystic fluid, sputum, stool, pleural effusion, mucus, pleural fluid, ascitic fluid, amniotic fluid, peritoneal fluid, saliva, bronchial washes and urine). In some specific examples, the biological samples comprises RNAs obtained from tumour tissues, such as formalin-fixed tumour tissue, paraffin embedded (FFPE)-fixed tumour tissue, or tissue from fresh-frozen tumours.

Results of each of the multiplexed amplification reaction conducted using the kit of the first aspect could be analyzed using known methods of multiplex amplification reaction analysis. When the amplification reaction used is a real-time polymerase chain reaction (real-time PCR), the results from the real-time PCR reactions are analyzed mainly using the Ct value.

The term "Ct value" or threshold cycle value as used interchangeably herein refers to the cycle number at which the fluorescence generated within a reaction crosses the fluorescence threshold, a fluorescent signal significantly above the background fluorescence. At the threshold cycle, a detectable amount of amplicon product has been generated during the early exponential phase of the reaction. The threshold cycle is inversely proportional to the original relative expression level of the gene of interest.

In a real-time PCR reaction, the Ct value could be easily obtained based on an amplification curve and the fluorescence threshold. An amplification curve is a semi-logarithmic curve obtained for a dilution series of a sample, with the Y-axis representing the fluorescence level in log-scale, and the X-axis representing the cycle number. An amplification curve has an initial phase, an exponential phase, and a plateau phase.

Based on the amplification curve of each of the target sequence of interest in the multiplexed amplification reaction, a Ct value could be obtained for each of the target sequence. The Ct value of a target gene-fusion sequence of interest is denoted by $Ct_f$, and the Ct value of a target wild-type control sequence of interest is denoted by $Ct_c$. When more than one wild-type control is used, the different $Ct_c$ values can be denoted by $Ct_{c1}$, $Ct_{c2}$, and so forth. The difference between the Ct value of a target gene-fusion of interest and a target wild-type control sequence of interest is denoted by $\Delta Ct$, with $\Delta Ct = Ct_f - Ct_c$. When more than one wild-type control is used, the different $\Delta Ct$ values can be denoted by $\Delta Ct_1$, $_\Delta Ct_2$, and so forth. The $\Delta Ct$ for each gene-fusion indicates the proportion of fusion within the sample.

The Ct value of each of the positive control reactions must fall within a pre-determined Ct value range in order to ensure that the multiplexed amplification reaction is set up properly. For example, when the positive control reaction is a positive control for the target gene-fusion of interest, the Ct value of the target gene-fusion of interest must fall within the pre-determined Ct value range; when the positive control reaction is a positive control for the target wild-type gene of interest, the Ct value of the target wild-type gene of interest must fall within the pre-determined Ct value range. The Ct value range is typically from about 15 to about 40, or from about 16 to about 39, or from about 17 to about 38, or from about 18 to about 37, or from about 19 to about 36, or from about 20 to about 35, or from about 21 to about 34, or from about 22 to about 33, or from about 23 to about 32, or from about 24 to about 31, or from about 25 to about 30, or from about 26 to about 29, or from about 27 to about 28. If the Ct value of the positive control falls outside the pre-determined range, the positive control reaction is considered as a fail.

The Ct value of the both the target gene-fusion of interest and the target wild-type gene(s) of interest in the negative control reaction should be above about 40, in order to ensure that there is no contamination in the reaction set up. The Ct value of the internal control in the negative control reaction must fall within a pre-determined Ct value range. The Ct value range is typically from about 15 to about 40, or from about 16 to about 39, or from about 17 to about 38, or from about 18 to about 37, or from about 19 to about 36, or from about 20 to about 35, or from about 21 to about 34, or from about 22 to about 33, or from about 23 to about 32, or from about 24 to about 31, or from about 25 to about 30, or from about 26 to about 29, or from about 27 to about 28. If the Ct value of the internal control in the negative control reaction falls outside the pre-determined range, the negative control reaction is considered as a fail.

When either one of the positive control reaction and the negative control reaction described above fails, the results from all the test reactions should not be used. When both the positive control reaction and the negative control reaction described above are successfully set up, the results obtained from the test reaction(s) could be used for sample analysis.

In each test reaction, the Ct value of the internal control reaction must fall within a pre-determined Ct value range. The Ct value range is typically from about 15 to about 40, or from about 16 to about 39, or from about 17 to about 38, or from about 18 to about 37, or from about 19 to about 36, or from about 20 to about 35, or from about 21 to about 34, or from about 22 to about 33, or from about 23 to about 32, or from about 24 to about 31, or from about 25 to about 30, or from about 26 to about 29, or from about 27 to about 28. If the Ct value of the internal control in one particular test reaction falls outside the pre-determined range, this test reaction is considered as a fail, and the results obtained from this test reaction should be disregarded when analyzing the sample.

In a test reaction, if the Ct value of the target gene-fusion of interest (i.e. $Ct_f$) falls within a pre-determined Ct value range, the test reaction is considered as amplification positive for the target gene-fusion of interest. If the $Ct_f$ falls above the upper limit of the pre-determined Ct value range, the test reaction is considered as amplification negative for the target gene-fusion of interest. Similarly, if the Ct value of the target wild-type control(s) of interest (i.e. $Ct_{c1}$, $Ct_{c2}$, etc.) falls within a pre-determined Ct value range, the test reaction is considered as amplification positive for the target wild-type control of interest. If the $Ct_{c1}$ and/or $Ct_{c2}$, etc. falls above the upper limit of the pre-determined Ct value range, the test reaction is considered as amplification negative for the target wild-type control of interest. The Ct value range is typically from about 15 to about 40, or from about 16 to about 39, or from about 17 to about 38, or from about 18 to about 37, or from about 19 to about 36, or from about 20 to about 35, or from about 21 to about 34, or from about 22 to about 33, or from about 23 to about 32, or from about 24 to about 31, or from about 25 to about 30, or from about 26 to about 29, or from about 27 to about 28.

When the test reaction is amplification negative for the target gene-fusion of interest, the subject being tested is identified as not suffering from a malignancy that is sensitive to treatment with an inhibitor of the Wnt signaling pathway. When the test reaction is amplification positive for both the target gene-fusion of interest and the target wild-type control of interest, the value ΔCt (or $\Delta Ct_1$, $_A Ct_2$, etc.) as defined above is used to determine if the subject being tested is suffering from a malignancy that is sensitive to treatment with an inhibitor of the Wnt signaling pathway.

When value ΔCt (or $\Delta Ct_1$, $_A Ct_2$, etc.) is at or below the cutoff value, the subject being tested is identified as suffering from a malignancy that is sensitive to treatment with an inhibitor of the Wnt signaling pathway. When the ΔCt (or $\Delta Ct_1$, $_A Ct_2$, etc.) is above the cutoff value, the subject being tested is identified as not suffering from a malignancy that is sensitive to treatment with an inhibitor of the Wnt signaling pathway.

Results from the test reaction could also be used for detection of cancer. When the test reaction is amplification negative for the target gene-fusion of interest, the subject being tested is identified as not suffering from cancer. When the test reaction is amplification positive for both the target gene-fusion of interest and the target wild-type control of interest, the value ΔCt (or $\Delta Ct_1$, $_A Ct_2$, etc.) as defined above is used to determine if the subject being tested is suffering from cancer. When value ΔCt (or $\Delta Ct_1$, $_A Ct_2$, etc.) is at or below the cutoff value, the subject being tested is identified as suffering cancer. When the ΔCt (or $\Delta Ct_1$, $_A Ct_2$, etc.) is above the cutoff value, the subject being tested is identified as not suffering from cancer.

The multiplexed amplification reactions conducted using the kit as disclosed herein allow the results to be available for analysis within a short period of time, which is often shorter than 2 days, or 1 day, or 22 hours, or 20 hours, or 18 hours, or 16 hours, or 12 hours, or 10 hours, or 8 hours, or 6 hours, or 4 hours, or 2 hours.

In a fourth aspect, there is provided a method of treating a subject suffering from a malignancy, the method comprises identifying the malignancy using the kit of the first aspect, or the method of the second or the third aspect; and treating the subject with an inhibitor of the Wnt signaling pathway. There is also provided use of an inhibitor of the Wnt signaling pathway in the manufacture of a medicament for the treatment of a malignancy sensitive to treatment with an inhibitor of the Wnt signaling pathway, wherein the malignancy is identified using the kit of the first aspect, or the method of the second or the third aspect.

A measure of the binding of an inhibitor to and the subsequent release from an enzyme is the "$IC_{50}$" value, which reflects the inhibitor concentration, which at a given substrate concentration results in 50% enzyme activity.

The term "therapeutically effective amount" as used herein, means that amount of active compound or pharmaceutical agent that elicits the biological or medicinal response in a tissue system, animal or human being sought by a researcher, veterinarian, medical doctor or other clinician, which includes alleviation of the symptoms of the disease or disorder being treated.

As used herein, the term "pharmaceutically acceptable" embraces both human and veterinary use: For example the term "pharmaceutically acceptable" embraces a veterinarily acceptable compound or a compound acceptable in human medicine and health care. In one example, human medicine and health care is excluded.

The term "optionally substituted" signifies that one or more substituents may be present or there may be no substituents. Substituents may or may not be present on the above groups (alkyl, aryl, heteroaryl, non-aromatic rings). There may be 0, 1, 2, 3 or 4 or more than 4 substituents on a group, as dictated by the structure of the group. Possible substituents include halogens (e.g. fluorine, chlorine or bromine), alkyl groups, alkoxy groups (i.e. O-alkyl, where alkyl is as defined above), aryloxy groups (i.e. O-aryl, where aryl is as defined above), ester, amide or sulfonate ester groups (i.e. $CO_2R$, CONHR, $SO_3R$, where R is alkyl as defined above), however other substituents may additionally or alternatively be present. In cases where substituents are shown, the term "optionally substituted" indicates the possibility of additional substituents that are not shown. Thus for example in structure I, when it is stated that Ar is "optionally substituted", this indicates the possibility of further substituents additional to Cy and $NR^5$, but does not indicate the possibility that either Cy or $NR^5$ might be absent. Thus, for example, in cases where it is stated that Ar is a "disubstituted" aromatic ring, this should be taken to mean that there are only two substituents on the ring, i.e. no additional substituents other than Cy and the amide nitrogen. For example, the 1,4-phenylene group in compound 1 is regarded as "disubstituted".

Throughout the description and the claims the expression "alkyl", unless specifically limited, denotes a $C_{1-12}$ alkyl group or more than $C_{1-12}$ alkyl group, suitably a $C_{1-6}$ alkyl group, e.g. $C_{1-4}$ alkyl group. Alkyl groups may be straight chain or branched. Suitable alkyl groups include, for example, methyl, ethyl, propyl (e.g. n-propyl and isopropyl), butyl (e.g. n-butyl, iso-butyl, sec-butyl and tert-butyl), pentyl (e.g. n-pentyl), hexyl (e.g. n-hexyl), heptyl (e.g. n-heptyl), octyl (e.g. n-octyl), isooctyl, decyl and dodecyl. The expression "alk", for example in the expressions "alkoxy", "haloalkyl" and "thioalkyl" should be interpreted in accordance with the definition of "alkyl". Exemplary alkoxy groups include methoxy, ethoxy, propoxy (e.g. n-propoxy), butoxy (e.g. n-butoxy), pentoxy (e.g. n-pentoxy), hexoxy (e.g. n-hexoxy), heptoxy (e.g. n-heptoxy) and octoxy (e.g. n-octoxy). Exemplary thioalkyl groups include methylthio-. Exemplary haloalkyl groups include fluoroalkyl e.g. $CF_3$. In certain instances they may contain cyclic structures. Exemplary cyclic structures groups include cyclohexyl, methylcyclohexyl, isopropylcyclopentyl, cyclobutylethyl etc. In certain examples they are not cage structures such as adamantyl.

The expression "alkenyl", unless specifically limited, denotes a $C_{2-12}$ alkenyl group, suitably a $C_{2-6}$ alkenyl group, e.g. a $C_{2-4}$ alkenyl group, which contains at least one double bond at any desired location and which does not contain any triple bonds. Alkenyl groups may be straight chain or branched. Exemplary alkenyl groups including one double bond include propenyl and butenyl. Exemplary alkenyl groups including two double bonds include pentadienyl, e.g. (1E, 3E)-pentadienyl.

The expression "alkynyl", unless specifically limited, denotes a $C_{2-12}$ alkynyl group, suitably a $C_{2-6}$ alkynyl group, e.g. a $C_{2-4}$ alkynyl group, which contains at least one triple bond at any desired location and may or may not also contain one or more double bonds. Alkynyl groups may be straight chain or branched. Exemplary alkynyl groups include propynyl and butynyl.

The expression "alkylene" denotes a chain of formula —(CH$_2$)$_n$— wherein n is an integer e.g. 1-12, 1-6, 2-6 or 2-5, unless specifically limited.

The expression "cycloalkyl", unless specifically limited, denotes a C$_{3-10}$ cycloalkyl group (i.e. 3 to 10 ring carbon atoms), more suitably a C$_{3-8}$ cycloalkyl group, e.g. a C$_{3-6}$ cycloalkyl group. Exemplary cycloalkyl groups include cyclopropyl, cyclobutyl, cyclopentyl, cyclohexyl, cycloheptyl and cyclooctyl. A most suitable number of ring carbon atoms is three to six.

The expression "cycloalkenyl", unless specifically limited, denotes a C$_{3-10}$ cycloalkenyl group (i.e. 3 to 10 ring carbon atoms), suitably a C$_{5-10}$ cycloalkenyl group (i.e. 5 to 10 ring carbon atoms), more suitably a C$_{5-8}$ cycloalkenyl group e.g. a C$_{5-6}$ cycloalkenyl group. Exemplary cycloalkenyl groups include cyclopropenyl, cyclohexenyl, cycloheptenyl and cyclooctenyl. A most suitable number of ring carbon atoms is five to six.

The expression "carbocyclyl", unless specifically limited, denotes any ring system in which all the ring atoms are carbon and which contains between three and twelve ring carbon atoms, suitably between three and ten carbon atoms and more suitably between three and eight carbon atoms. Carbocyclyl groups may be saturated or partially unsaturated, but do not include aromatic rings. Examples of carbocyclyl groups include monocyclic, bicyclic, and tricyclic ring systems, in particular monocyclic and bicyclic ring systems. Other carbocyclyl groups include bridged ring systems (e.g. bicyclo[2.2.1]heptenyl). A specific example of a carbocyclyl group is a cycloalkyl group. A further example of a carbocyclyl group is a cycloalkenyl group.

The expressions "heterocyclyl" and "non-aromatic rings" may be used interchangeably within the description, unless specifically limited, refers to a carbocyclyl group wherein one or more (e.g. 1, 2 or 3) ring atoms are replaced by heteroatoms. The rings may have from 4 to 8 ring atoms, commonly 5 or 6. The heteroatom(s) are commonly selected from N, S and O. A specific example of a heterocyclyl group is a cycloalkyl group (e.g. cyclopentyl or more particularly cyclohexyl) wherein one or more (e.g. 1, 2 or 3, particularly 1 or 2, especially 1) ring atoms are replaced by heteroatoms selected from N, S or O. Exemplary heterocyclyl groups containing one hetero atom include pyrrolidine, tetrahydrofuran and piperidine, and exemplary heterocyclyl groups containing two hetero atoms include morpholine and piperazine. A further specific example of a heterocyclyl group is a cycloalkenyl group (e.g. a cyclohexenyl group) wherein one or more (e.g. 1, 2 or 3, particularly 1 or 2, especially 1) ring atoms are replaced by heteroatoms selected from N, S and O. An example of such a group is dihydropyranyl (e.g. 3,4-dihydro-2H-pyran-2-yl-). The heterocyclyl group may be linked to other part or parts of the molecule by a carbon ring atom or nitrogen ring atom. Group Cy in structure (I) may be, an example of such rings.

The expression "aryl", unless specifically limited, denotes a C$_{6-12}$ aryl group, suitably a C$_{6-10}$ aryl group, more suitably a C$_{6-8}$ aryl group. Aryl groups will contain at least one aromatic ring (e.g. one, two or three rings). Aryl groups with multiple aromatic rings include fused aromatic rings and aromatic rings connected to each other by one single bond. An example of a typical aryl group with one aromatic ring is phenyl. An example of a typical aryl group with two fused aromatic rings is naphthyl. An example of an aromatic group with two directly connected aromatic rings is biphenyl. Aryl groups may, unless otherwise specified, have any suitable substitution pattern, e.g. ortho, meta, para. Unless specified, they may have any appropriate number of substituents (e.g. a monocyclic aromatic may have from 1 to 5 substituents, a fused bicyclic aromatic may have from 1 to 7 substituents etc.).

The expression "heteroaryl", unless specifically limited, denotes an aryl residue, wherein one or more (e.g. 1, 2, 3, or 4, suitably 1, 2 or 3) ring atoms are replaced by heteroatoms, said heteroatoms commonly being selected (independently) from N, S and O, or else a 5-membered aromatic ring containing one or more (e.g. 1, 2, 3, or 4, suitably 1, 2 or 3) ring atoms, said heteroatoms commonly selected from N, S and O. A heteroaryl group will have no ring heteroatoms other than nitrogen. Heteroaryl groups typically have 5 or 6 ring atoms unless they are bicyclic or polycyclic. Unless otherwise specified, they may have any suitable substitution pattern and may have any appropriate number of substituents. Heteroaryl groups may be monocyclic or bicyclic or polycyclic. The fused rings may each be either a heteroaryl ring or a homoaryl ring, provided that at least one is heteroaryl. Exemplary monocyclic heteroaryl groups having one heteroatom include: five membered rings (e.g. pyrrole, furan, thiophene); and six membered rings (e.g. pyridine, such as pyridin-2-yl, pyridin-3-yl and pyridin-4-yl). Exemplary monocyclic heteroaryl groups having two heteroatoms include: five membered rings (e.g. pyrazole, oxazole, isoxazole, thiazole, isothiazole, imidazole, such as imidazol-1-yl, imidazol-2-yl, imidazol-4-yl); and six membered rings (e.g. pyridazine, pyrimidine, pyrazine). Exemplary monocyclic heteroaryl groups having three heteroatoms include: 1,2,3-triazole, 1,2,4-triazole, 1,2,3-oxadiazole and 1,2,4-oxadiazole. Exemplary monocyclic heteroaryl groups having four heteroatoms include tetrazole. Exemplary bicyclic heteroaryl groups include: indole (e.g. indol-6-yl), benzofuran, benzthiophene, quinoline, isoquinoline, indazole, benzimidazole, benzthiazole, quinazoline and purine. The heteroaryl group may be linked to other part or parts of the molecule by a carbon ring atom or nitrogen ring atom.

The aforementioned aryl and heteroaryl groups may, where appropriate, optionally be substituted by one or more (e.g. 1, 2 or 3, suitably 1 or 2) groups each independently selected from monovalent or multivalent (i.e. having valency greater than 1) functional groups. Suitable substituent groups include alkyl, alkenyl, alkynyl, haloalkyl, -alkoxy (e.g. OMe), cycloalkyl, alkenyloxy-, alkynyloxy-, alkoxyalkyl-, nitro, halogen (e.g. fluoro, chloro and bromo), cyano, hydroxyl, oxo, —C(O)-alkyl (e.g. COMe), C(O)OH, —C(O)Oalkyl (e.g. —C(O)OMe), —OC(O)alkyl (e.g. —OC(O)Me), —NH$_2$, —NHalkyl (e.g. —NHMe), —N(alkyl)$_2$ (e.g. dimethylamino-), —C(O)NH$_2$, —C(O)NH(alkyl) (e.g. —C(O)NHMe), —NHC(O)alkyl (e.g. —NHC(O)Me), —C(NH)NH$_2$, thioalkyl (e.g. -thiomethyl), —SO$_2$alkyl (e.g. SO$_2$Me), —SOalkyl (e.g. —SOMe), —SO$_2$cycloalkyl and —SOcycloalkyl. More typically, substituents will be selected from alkyl (e.g. Me), fluoroalkyl (e.g. CF$_3$ and CHF$_2$), alkoxy (e.g. OMe), halogen and hydroxyl.

The expression "-alkylaryl", unless specifically limited, denotes an aryl residue which is connected via an alkylene moiety e.g. a C$_{1-4}$alkylene moiety. An example of such a group is benzyl: PhCH$_2$—.

The term "halogen" or "halo" comprises fluorine (F), chlorine (Cl) and bromine (Br).

The term "amino" refers to the group —NH$_2$.

The term "oxo" refers to an oxygen atom which, together with the carbon atom which it substitutes, forms a carbonyl group C=O.

The term "-arylheterocyclyl" refers to a heterocyclyl residue which is connected via an aryl moiety.

The term "bond" is a linkage between atoms in a compound or molecule. The bond may be a single bond, a double bond, or a triple bond.

Stereoisomers:

All possible stereoisomers of the claimed compounds are included in the present invention.

Where the compounds according to this invention have at least one chiral center, they may accordingly exist as enantiomers. Where the compounds possess two or more chiral centers, they may additionally exist as diastereomers. It is to be understood that all such isomers and mixtures thereof are encompassed within the scope of the present invention.

Preparation and Isolation of Stereoisomers:

Where the processes for the preparation of the compounds according to the invention give rise to a mixture of stereoisomers, these isomers may be separated by conventional techniques such as preparative chromatography. The compounds may be prepared in racemic form, or individual enantiomers may be prepared either by enantiospecific synthesis or by resolution. The compounds may, for example, be resolved into their components enantiomers by standard techniques, such as the formation of diastereomeric pairs by salt formation with an optically active acid, such as (−)-di-p-toluoyl-d-tartaric acid and/or (+)-di-p-toluoyl-1-tartaric acid followed by fractional crystallization and regeneration of the free base. The compounds may also be resolved by formation of diastereomeric esters or amides, followed by chromatographic separation and removal of the chiral auxiliary. Alternatively, the compounds may be resolved using a chiral HPLC column.

Pharmaceutically Acceptable Salts:

In view of the close relationship between the free compounds and the compounds in the form of their salts or solvates, whenever a compound is referred to in this context, a corresponding salt, solvate or polymorph is also intended, provided such is possible or appropriate under the circumstances.

Salts and solvates of the compounds of formula (I) and physiologically functional derivatives thereof which are suitable for use in medicine are those wherein the counter-ion or associated solvent is pharmaceutically acceptable. However, salts and solvates having non-pharmaceutically acceptable counter-ions or associated solvents are within the scope of the present invention, for example, for use as intermediates in the preparation of other compounds and their pharmaceutically acceptable salts and solvates.

Suitable salts according to the invention include those formed with both organic and inorganic acids or bases. Pharmaceutically acceptable acid addition salts include those formed from hydrochloric, hydrobromic, sulfuric, nitric, citric, tartaric, phosphoric, lactic, pyruvic, acetic, trifluoroacetic, triphenylacetic, sulfamic, sulfanilic, succinic, oxalic, fumaric, maleic, malic, mandelic, glutamic, aspartic, oxaloacetic, methanesulfonic, ethanesulfonic, arylsulfonic (for example p-toluenesulfonic, benzenesulfonic, naphthalenesulfonic or naphthalenedisulfonic), salicylic, glutaric, gluconic, tricarballylic, cinnamic, substituted cinnamic (for example, phenyl, methyl, methoxy or halo substituted cinnamic, including 4-methyl and 4-methoxycinnamic acid), ascorbic, oleic, naphthoic, hydroxynaphthoic (for example 1- or 3-hydroxy-2-naphthoic), naphthaleneacrylic (for example naphthalene-2-acrylic), benzoic, 4-methoxybenzoic, 2- or 4-hydroxybenzoic, 4-chlorobenzoic, 4-phenylbenzoic, benzeneacrylic (for example 1,4-benzenediacrylic), isethionic acids, perchloric, propionic, glycolic, hydroxyethanesulfonic, pamoic, cyclohexanesulfamic, salicylic, saccharinic and trifluoroacetic acid. Pharmaceutically acceptable base salts include ammonium salts, alkali metal salts such as those of sodium and potassium, alkaline earth metal salts such as those of calcium and magnesium and salts with organic bases such as dicyclohexylamine and N-methyl-D-glucamine.

All pharmaceutically acceptable acid addition salt forms of the compounds of the present invention are intended to be embraced by the scope of this invention.

Polymorph Crystal Forms:

Furthermore, some of the crystalline forms of the compounds may exist as polymorphs and as such are intended to be included in the present invention. In addition, some of the compounds may form solvates with water (i.e. hydrates) or common organic solvents, and such solvates are also intended to be encompassed within the scope of this invention. The compounds, including their salts, can also be obtained in the form of their hydrates, or include other solvents used for their crystallization.

Prodrugs:

The present invention further includes within its scope prodrugs of the compounds of this invention. In general, such prodrugs will be functional derivatives of the compounds which are readily convertible in vivo into the desired therapeutically active compound. Thus, in these cases, the methods of treatment of the present invention, the term "administering" shall encompass the treatment of the various disorders described with prodrug versions of one or more of the claimed compounds, but which converts to the above specified compound in vivo after administration to the subject.

Protective Groups:

During any of the processes for preparation of the compounds of the present invention, it may be necessary and/or desirable to protect sensitive or reactive groups on any of the molecules concerned. This may be achieved by means of conventional protecting groups. The protecting groups may be removed at a convenient subsequent stage using methods known from the art.

As used herein, the term "composition" is intended to encompass a product comprising the claimed compounds in the therapeutically effective amounts, as well as any product which results, directly or indirectly, from combinations of the claimed compounds.

Carriers and Additives for Galenic Formulations:

Carriers, which can be added to the mixture, include necessary and inert pharmaceutical excipients, including, but not limited to, suitable binders, suspending agents, lubricants, flavorants, sweeteners, preservatives, coatings, disintegrating agents, dyes and coloring agents.

Thus, for liquid oral preparations, such as for example, suspensions, elixirs and solutions, suitable carriers and additives may advantageously include water, glycols, oils, alcohols, flavoring agents, preservatives, coloring agents and the like; for solid oral preparations such as, for example, powders, capsules, gelcaps and tablets, suitable carriers and additives include starches, sugars, diluents, granulating agents, lubricants, binders, disintegrating agents and the like.

Soluble polymers as targetable drug carriers can include polyvinylpyrrolidone, pyran copolymer, polyhydroxypropylmethacrylamidephenol, polyhydroxyethylaspartamide-phenol, or polyethyleneoxide-polyllysine substituted with palmitoyl residue. Furthermore, the compounds of the present invention may be coupled to a class of biodegradable polymers useful in achieving controlled release of a drug, for example, polyactic acid, polyepsilon caprolactone, polyhydroxy butyeric acid, polyorthoesters, polyacetals, polydihydropyrans, polycyanoacrylates and cross-linked or amphipathic block copolymers of hydrogels.

Suitable binders include, without limitation, starch, gelatin, natural sugars such as glucose or betalactose, corn sweeteners, natural and synthetic gums such as acacia, tragacanth or sodium oleate, sodium stearate, magnesium stearate, sodium benzoate, sodium acetate, sodium chloride and the like.

Disintegrators include, without limitation, starch, methyl cellulose, agar, bentonite, xanthan gum and the like.

Exemplary, non-limiting embodiments of a Wnt inhibitor having structure (I) will now be disclosed.

The present disclosure provides a Wnt inhibitor having structure (I):

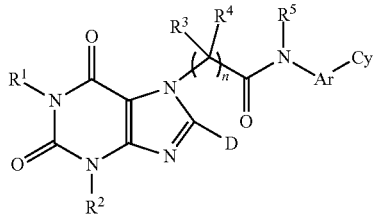

wherein:

$R^1$, $R^2$, $R^3$, $R^4$ and $R^5$ each, independently, may be H or an alkyl group;

D may be selected from the group consisting of H, halogen, alkyl, cycloalkyl, aryl, and dialkylamino, each (other than H and halogen) being optionally substituted;

Ar may be an aryl or heteroaryl group, each being optionally substituted;

Cy may be an aryl, heteroaryl or a saturated ring containing at least one heteroatom, each being optionally substituted; and n may be an integer from 1 to 3.

In some examples, if n=1 and one of $R^3$ and $R^4$ is methyl and the other is H, the stereochemistry of the compound is as shown in partial structure (II)

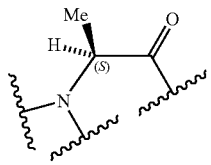

In some particular examples, n=1 and one of $R^3$ and $R^4$ is methyl and the other is H and the stereochemistry of the compound is as shown in partial structure (II).

The compounds referred to hereinafter as compound 5 of Structure (I) (also referred to as ETC-1922159 or ETC-159 in short) is explicitly included within the scope of the Wnt inhibitor having structure (I). Compound 5 of Structure (I) is further known as a compound of the structure (IV) as defined thereafter.

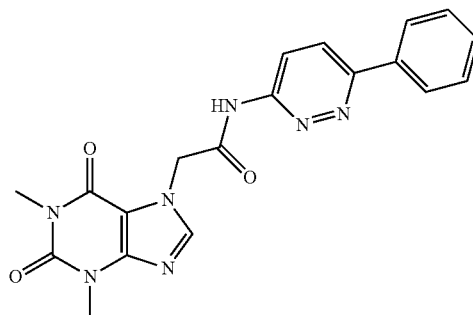

The following particular options may be used in conjunction with the Wnt inhibitor having structure (I), either individually or in any suitable combination.

$R^1$ and $R^2$ may, independently, be methyl or ethyl. They may both be methyl. $R^3$ and $R^4$ may both be H. They may both be alkyl, e.g. methyl or ethyl. One of $R^3$ and $R^4$ may be alkyl (e.g. methyl or ethyl) and the other H. $R^5$ may be hydrogen. It may be methyl or may be some other alkyl.

If Ar is a 6-membered ring, it may be 1,4-disubstituted. If Ar is a 5-membered ring it may be 1,3-disubstituted. Ar may be a ring which is not 1,2-disubstituted. In this context, "disubstituted" refers to substitution by Cy and $NR^5$.

Ar may be a disubstituted benzene ring (i.e. a phenylene ring), a disubstituted thiophene ring or a disubstituted nitrogen heterocycle having between 1 and 4 nitrogen atoms. It may be a 6 membered aromatic ring having between 0 and 2 nitrogen atoms. It may be a ring that is not a 2-thiazolyl ring. It may be a pyridazine ring, e.g. a pyridazin-3,6-diyl.

Cy may be a 5 or 6 membered aromatic ring having between 0 and 2 nitrogen atoms, 0 or 1 sulfur atoms and 0 or 1 oxygen atoms. Alternatively it may be piperazine. The piperazine may be substituted on both nitrogen atoms. Cy may contain no chlorine. It may be a group that is not a chlorophenyl group (optionally additionally substituted). In some examples compound I has no chlorine.

n may be 1.

D may be H.

The modulating may be inhibiting.

In a particular example, $R^1$ and $R^2$ are both methyl. $R^3$, $R^4$, $R^5$ and D are all H and n is 1. In a specific instance of this example, Ar is a 6-membered ring having 1 or 2 nitrogen atoms and having no substituents other than Cy and the amide nitrogen, these being in a 1,4-relationship on the ring.

In structures (I) and (II) of the Wnt inhibitors, n may be 1 to 5. It may be 1 to 3. It may be any one of 1, 2, 3, 4 or 5. Substituent D may be H, halogen, alkyl, cycloalkyl, aryl, or dialkylamino, each (other than H and halogen) being optionally substituted. Examples include hydrogen, chlorine, bromine, methyl, ethyl, propyl, cyclopropyl, phenyl, trifluoromethyl, dimethylamino, N-piperidinyl, N-piperazinyl, N-methyl-N'-piperazinyl etc.

In many examples, n is 1.

In some cases, the substituents $R^3$ and $R^4$ are the same, and in others they are different. In the event that they are different, they give rise to stereochemistry at the carbon atom to which they are attached. In general the stereochemistry at that carbon (or at each carbon) may be (S) or (R). In the particular example where n is 1 and one of $R^3$ and $R^4$ is H and the other is an alkyl group, a preferred stereochemistry is as shown in structure (II), where Me may represent the alkyl group. In cases where the alkyl group is methyl, this stereochemistry is particularly preferred.

Examples of group Ar in structure (I) include 1,4-phenylene, 2,5-pyridinediyl, 3,6-pyridazinediyl, 2,5-pyrazinediyl, 2,5-thiophenediyl, 2,4-thiophenediyl, 2,5-furandiyl, 2,4-furandiyl, etc. Examples of group Cy in structure (I) include phenyl, thiazole-2-yl, thiophene-2-yl, thiophene-3-yl, pyridine-1-yl, pyridine-2-yl, pyridine-3-yl, pyridazine-3-yl, pyridazine-4-yl, pyrimidine-2-yl, pyrimidine-4-yl, pyrimidine-4-yl, N-imidazolyl, 2-, 4- or 5-thiazolyl, 2-, 4- or 5-oxazolyl, N-morpholinyl or N' substituted N-piperazinyl. Suitable substituents on the N' position of the piperazinyl substituent include —C(=O)X, where X is t-butoxy, neopentyl, methyl, phenyl, p-chlorophenyl, benzyl, α,α-difluorobenzyl, chlorobenzyl, fluorobenzyl etc.

In some examples, $R^1$ and $R^2$ are the same. They may be both methyl. They may be both ethyl. In the latter case, Ar may be 1,4-phenylene and Cy may be thiophene-3-yl.

In some examples D is H. In other examples, D may be methyl, cyclopropyl, trifluoromethyl, phenyl, dimethylamino, morpholin-N-yl, thiophene-3-yl or bromo. In the event that D is not H (e.g. is methyl, cyclopropyl, trifluoromethyl, phenyl, dimethylamino, morpholin-N-yl, thiophene-3-yl or bromo), Ar may be 1,4-phenylene and Cy may be thiophene-3-yl.

In some examples, n is 1 and in others it is 2 or 3. In the event that n is 2 or 3, Ar may be 1,4-phenylene and Cy may be thiophene-3-yl or thiazole-2-yl.

In some examples, $R^3$ and $R^4$ are either both H or both methyl. In other examples, one is H and the other is methyl or ethyl. In the event that they are not both H, Ar may be 1,4-phenylene. Alternatively, if they are not both H, either Ar is 1,4-phenylene or Cy is phenyl or either is thiazole-2-yl.

In some examples $R^5$ is H.

In some examples Ar is 1,4-phenylene and Cy is thiophene-3-yl or thiazole-2-yl. In particular examples Ar is 1,4-phenylene and Cy is thiophene-3-yl.

In a particular example, $R^1$ and $R^2$ are both Me, D is H, n is 1 and $R^3$ and $R^4$ are both H. In this example, it is preferred that if Ar is 1,4-phenylene, Cy is not thiophene-3-yl. In a variation of this example, either $R^1$ and $R^2$ are not both methyl, or D is not H, or n is not 1, or $R^3$ and $R^4$ are not both H (optionally more than one, and in particular instances all, of these apply) and Ar is 1,4-phenylene and Cy is thiophene-3-yl or thiazole-2-yl (optionally Ar is 1,4-phenylene and Cy is thiophene-3-yl).

In some examples, any one or more, optionally all, of compounds 7, 13, 27, 28, 39, 42, 43, 44, 58, 65, 71, 80 and 83 as defined as structure (I) may be excluded from the scope of the invention. In some examples, any one or more, optionally all, of compounds 8, 12, 55 and 85 may also be excluded.

In some examples, Ar and Cy are not both optionally substituted phenyl rings. In some examples, at least on of Ar and Cy is heteroaromatic or non-aromatic. In some examples at least one of Ar and Cy is heteroaromatic.

In some examples, if Ar is 1,4-phenylene or 2,5-pyridyl, Cy has no more than 1 ring nitrogen atom. In other examples, if Ar is a 5-membered ring, it is not oxazolediyl. In yet other examples, if Ar is a 5-membered ring, it may be thiophenediyl, e.g. thiophene-2,4-diyl. In the context of the present specification, reference to "if A then B" should be taken to indicate the possibilities either that A is not the case or that both A and B are the case. Therefore for example, the statement "if Ar is a 5-membered ring, it may be thiophenediyl" may be taken to mean that either Ar is not a 5-membered ring, or else Ar is a thiophenediyl ring. In such instances, Ar could be for example, a pyridinediyl ring, but could not be a furandiyl ring.

The present disclosure may encompasses in particular the anhydrous form of the free base of 2-(1,3-dimethyl-2,6-dioxo-1,2,3,6-tetrahydro-7H-purin-7-yl)-N-(6-phenylpyridazin-3-yl)acetamide which is of structure (I), pharmaceutical compositions containing the anhydrous form of this free base and methods of use of the anhydrous form of the free base in the treatment of certain medical conditions. This compound, 2-(1,3-dimethyl-2,6-dioxo-1,2,3,6-tetrahydro-7H-purin-7-yl)-N-(6-phenylpyridazin-3-yl)acetamide or 2-(1,3-dimethyl-2,6-dioxo-2,3-dihydro-1H-purin-7 (6H)-yl)-N-(6-phenylpyridazin-3-yl)acetamide of structure (I) is further labelled as a compound of structure (IV), wherein is also known as compound 5 of Structure (I) (ETC-159).

In relation to 2-(1,3-dimethyl-2,6-dioxo-1,2,3,6-tetrahydro-7H-purin-7-yl)-N-(6-phenylpyridazin-3-yl)acetamide of structure (I), initial studies were carried out on the free base, the preferred chemical form, and indicated that polymorphism was prevalent with the compound being found to adopt more than one crystalline form depending upon the manufacturing conditions. In addition it was observed that the moisture content varied from batch to batch.

Accordingly, a single polymorphic form of 2-(1,3-dimethyl-2,6-dioxo-1,2,3,6-tetrahydro-7H-purin-7-yl)-N-(6-phenylpyridazin-3-yl)acetamide of structure (I) which overcomes or ameliorates one or more of the above identified problems was prepared.

The present disclosure therefore encompasses an anhydrous form of the free base (non-hydrated single polymorph) of 2-(1,3-dimethyl-2,6-dioxo-1,2,3,6-tetrahydro-7H-purin-7-yl)-n-(6-phenylpyridazin-3-yl)acetamide of structure (I).

The anhydrous free base may be crystalline. The crystalline anhydrous free base shows on X-ray diffraction a peak on the 2theta scale at 22.2°±0.5°. It also shows on X-ray diffraction peaks on the 2theta scale at 5.5°±0.5° and 14.2°±0.5°. In particular, it shows on X-ray diffraction at least four peaks on the 2theta scale selected from the group consisting of 5.5°±0.5° and 12.5°±0.5°, 14.2°±0.5°, 16.7°±0.5°, 17.7°±0.5°, 18.8°±0.5°, 22.4°±0.5°, 24.2°±0.5° and 31.7°±0.5°. Specifically it shows on X-ray diffraction peaks on the 2theta scale of and 5.5°±0.5° and 12.5°±0.5°, 14.2°±0.5°, 16.7°±0.5°, 17.7°±0.5°, 18.0°±0.5°, 18.8°±0.5°, 19.6°±0.5°, 20.6°±0.5°, 22.4°±0.5°, 24.2°±0.5°, 24.4°±0.5°, 25.0°±0.5°, 27.0°±0.5°, 27.6°±0.5°, 29.8°±0.5°, 31.7°±0.5° and 32.2°±0.5°.

It will be understood that many (although not all) of the limitations set out above in various examples may be used together in combination, and the present invention explicitly contemplates such combinations where they are practicable.

Specific (but non-limiting) examples of the Wnt inhibitors having the structure (I) are set out below:

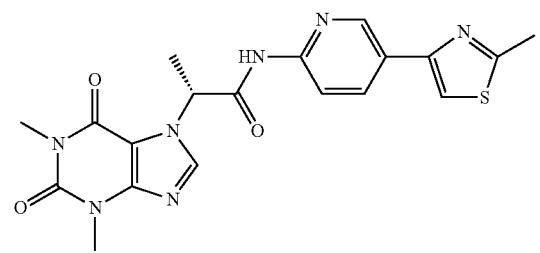

33
-continued
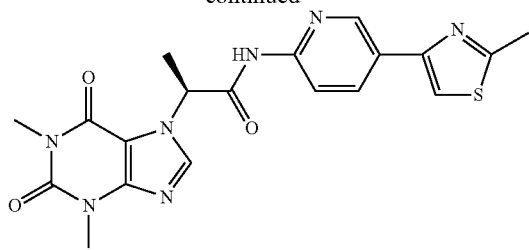
34
-continued
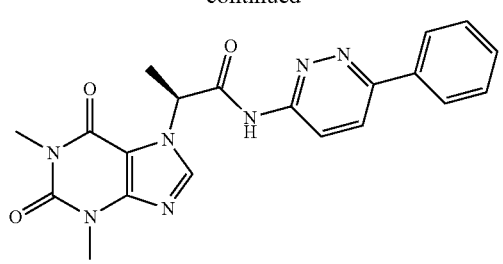
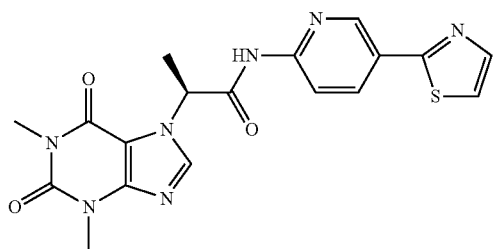
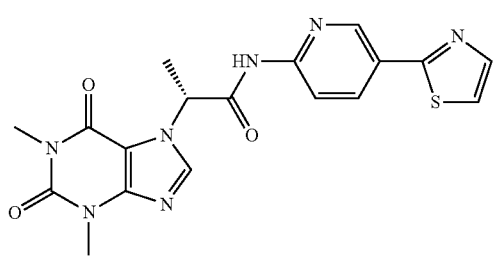
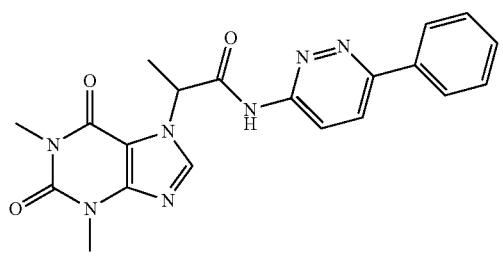
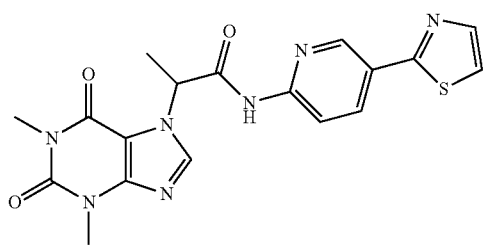
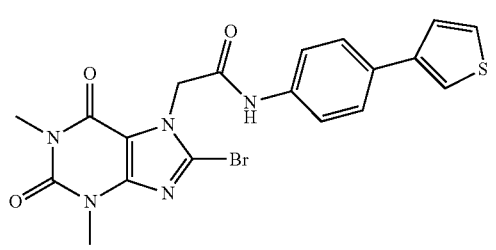
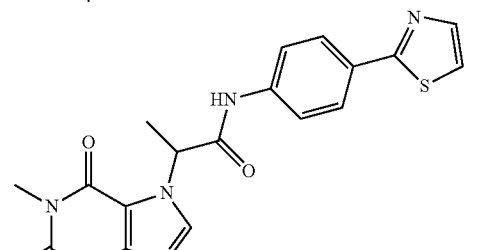
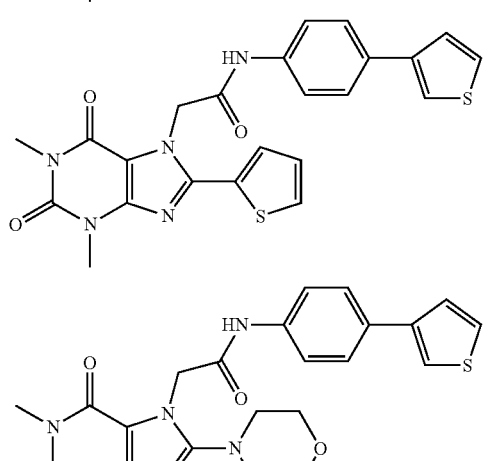

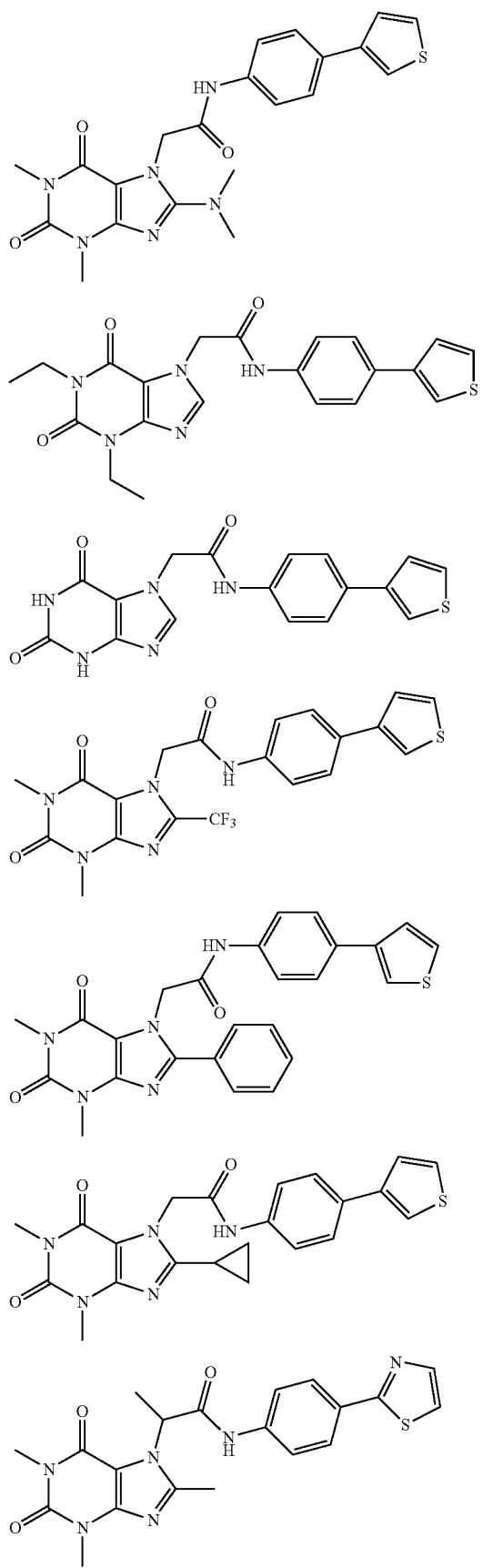
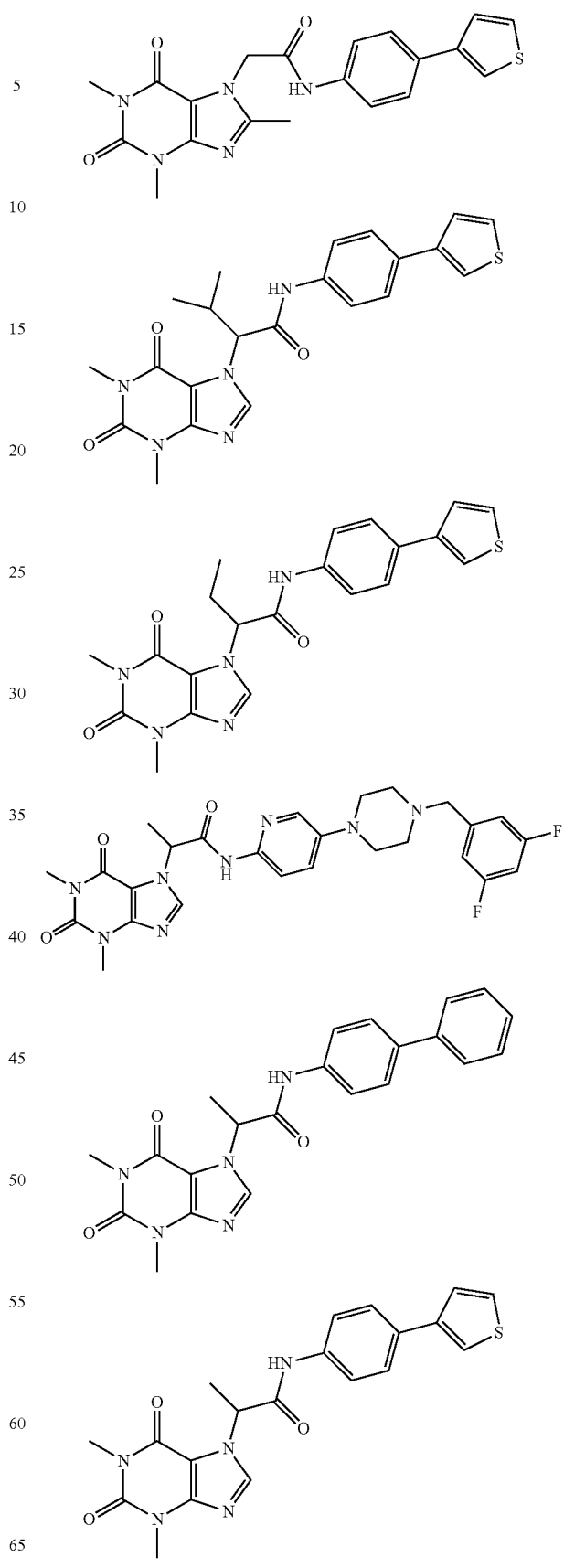

37
-continued
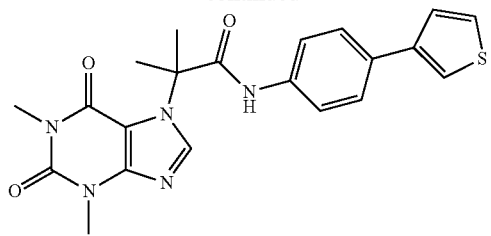
38
-continued
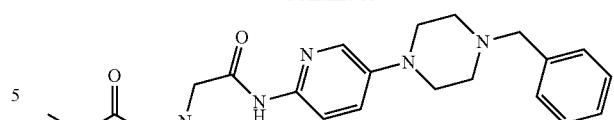
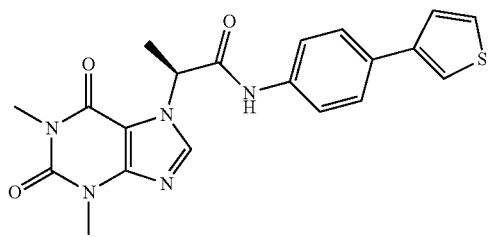
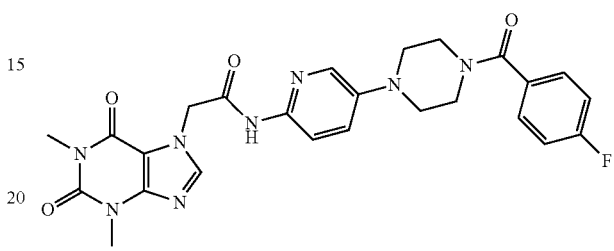
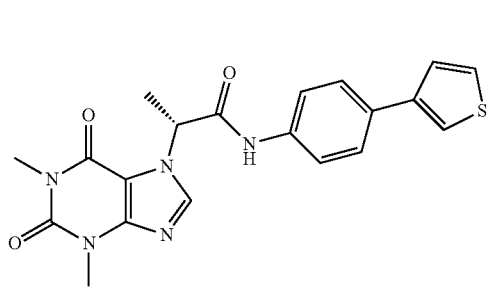
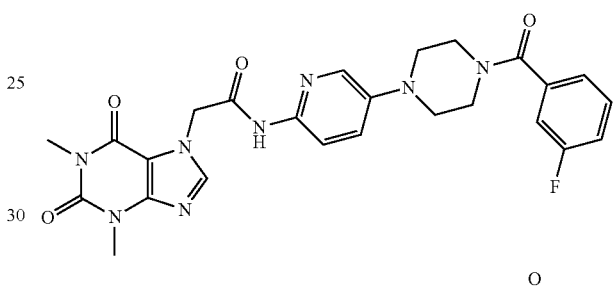
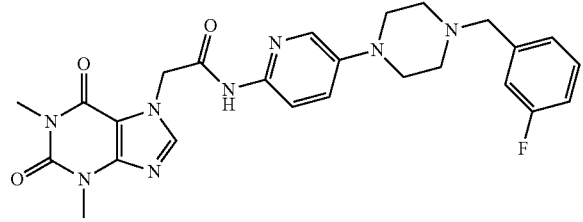
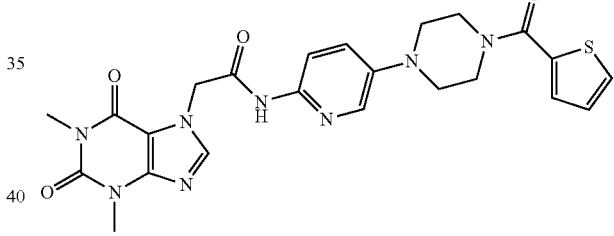
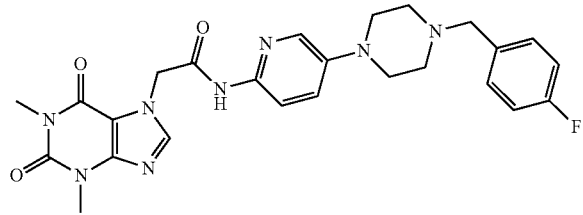
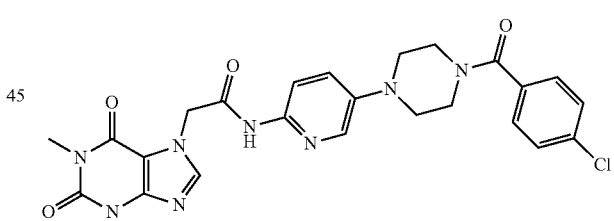
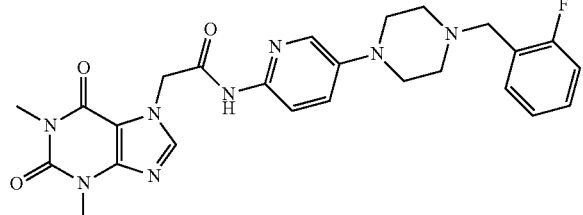
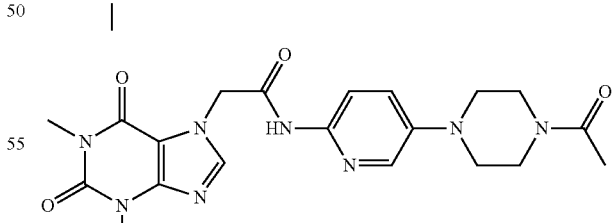
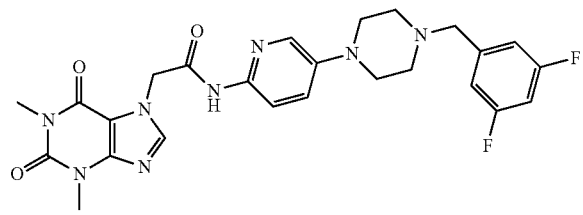
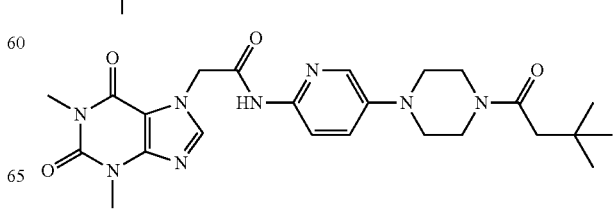

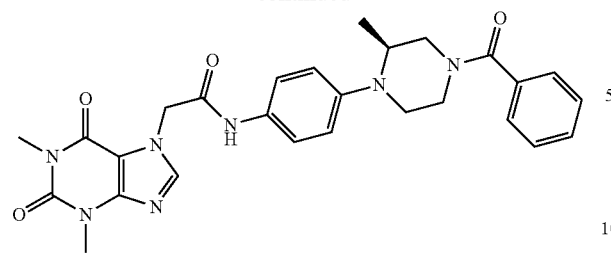
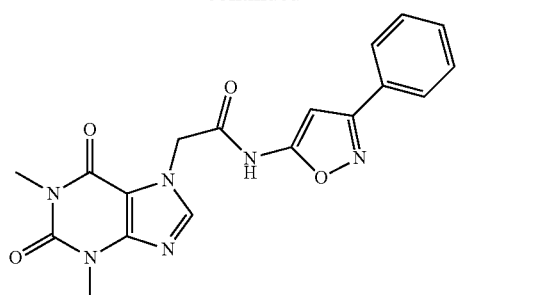
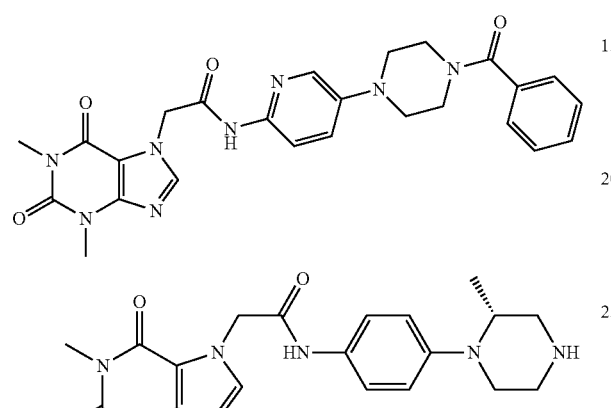
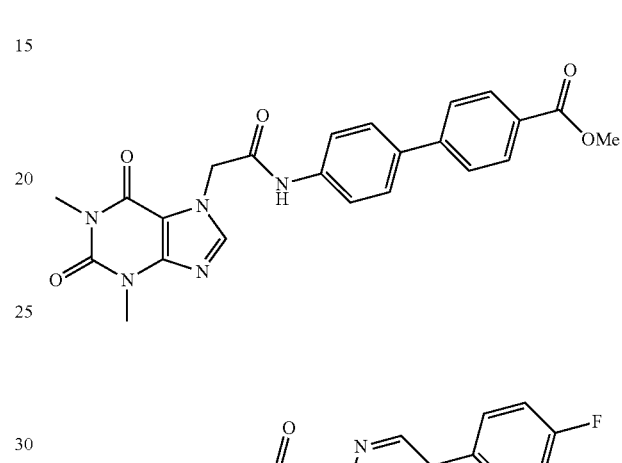
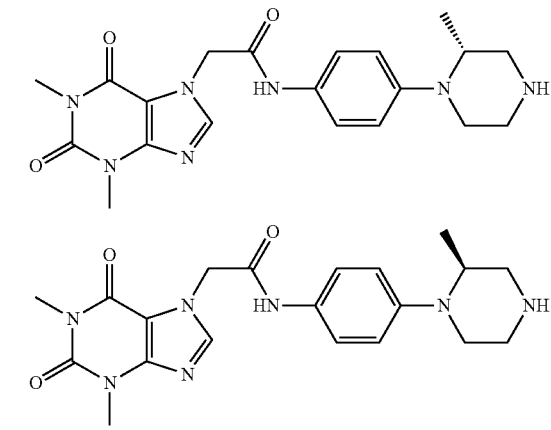
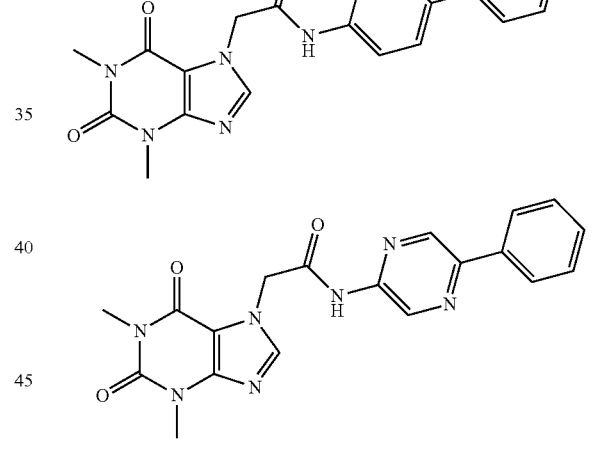
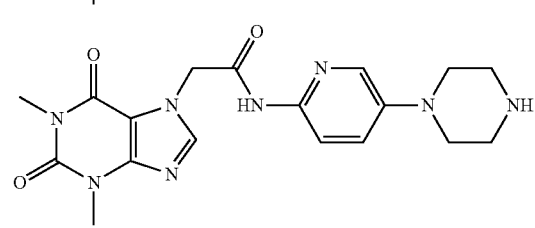
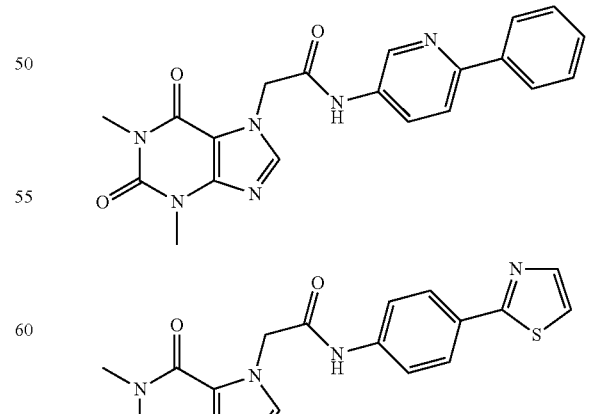
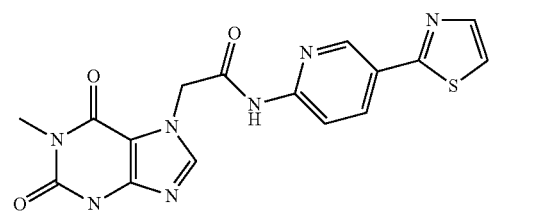
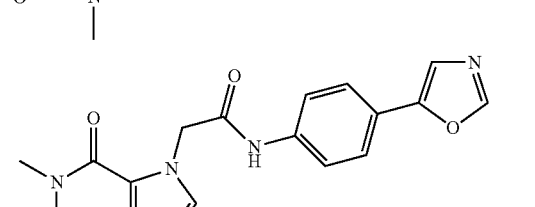
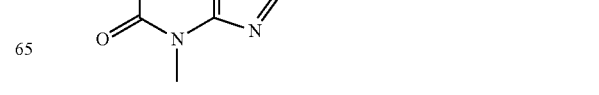

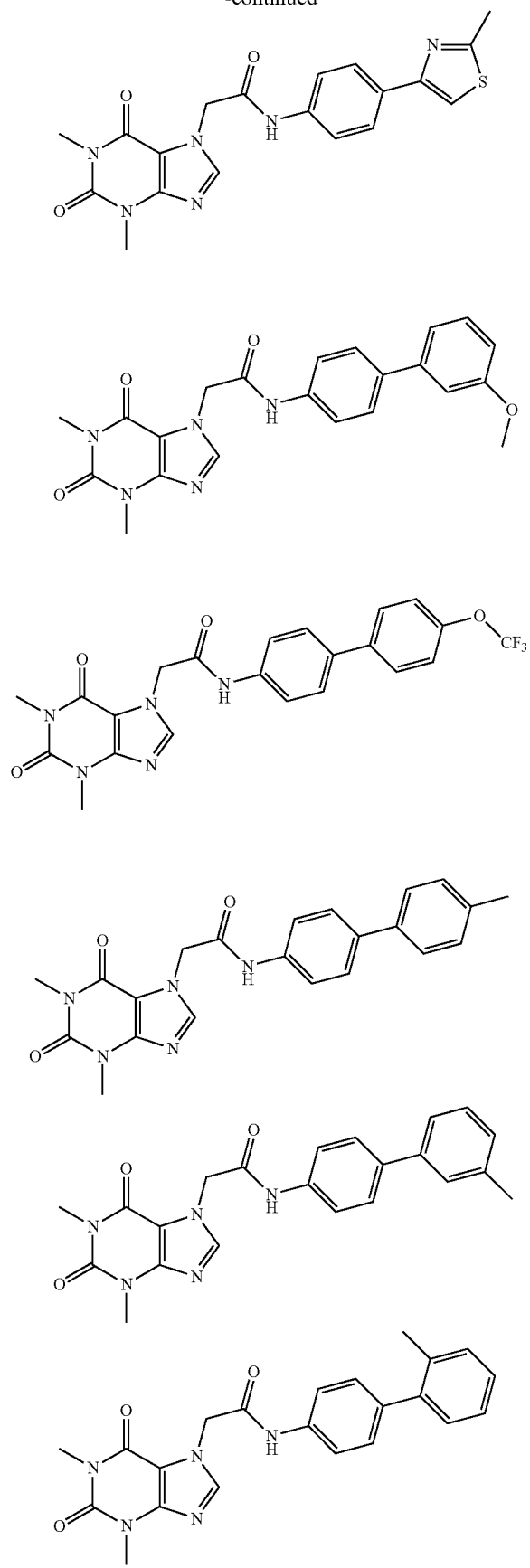

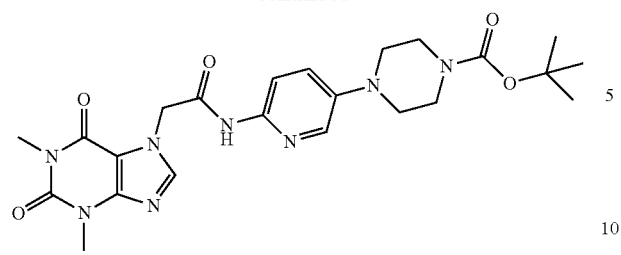
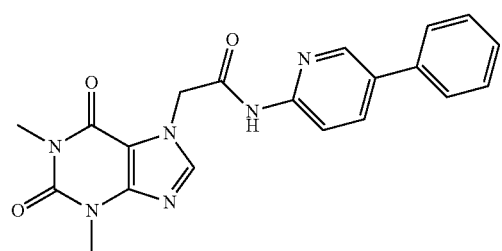
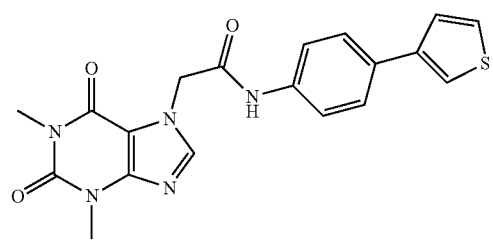
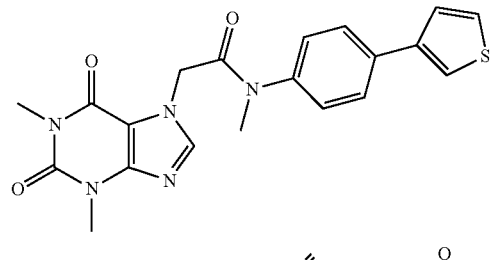
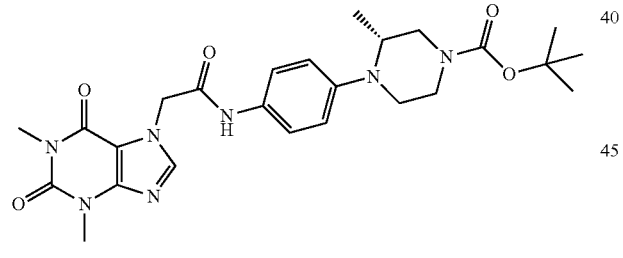
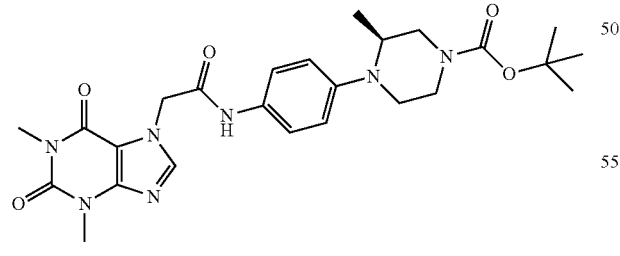
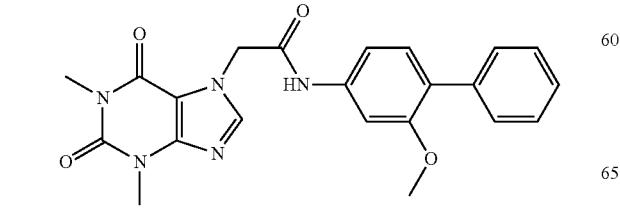
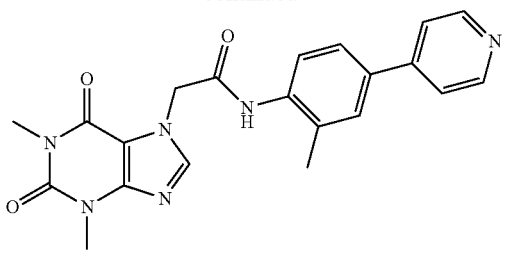
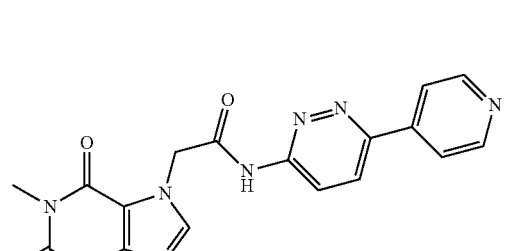
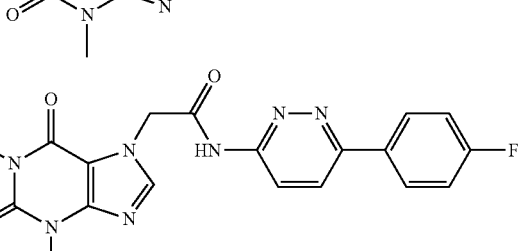
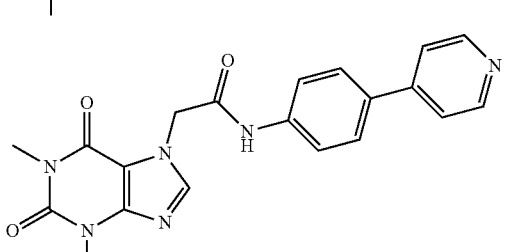
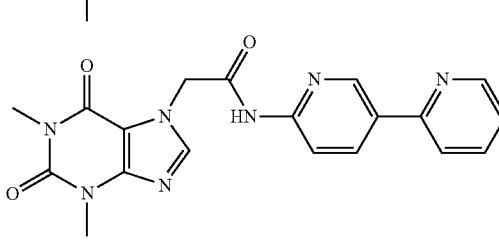
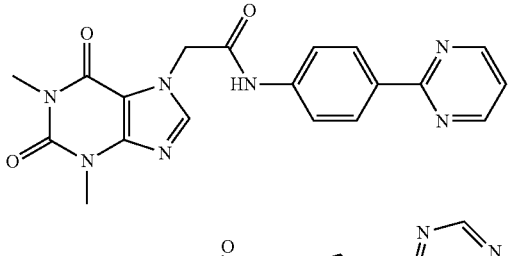
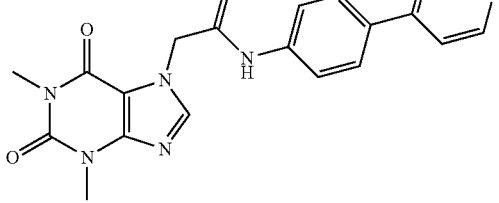

45
-continued
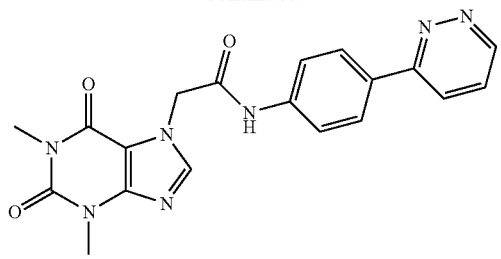
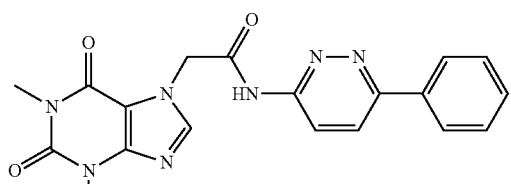
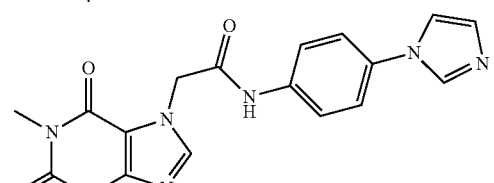
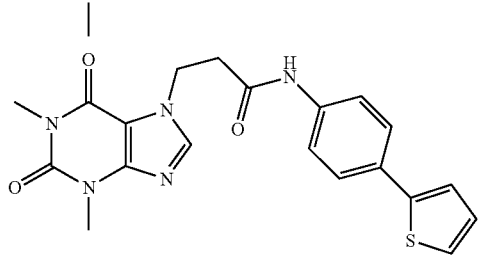
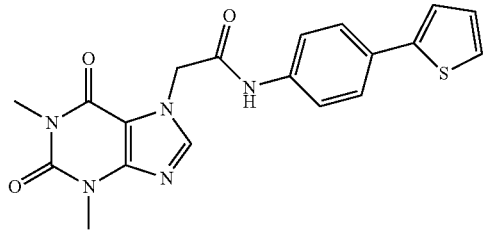
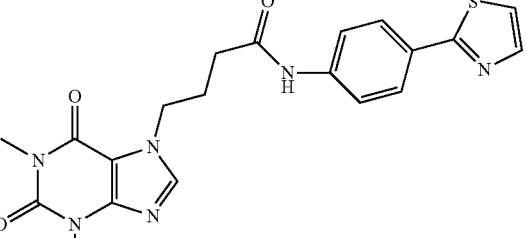
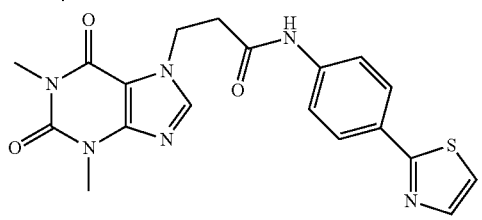
46
-continued
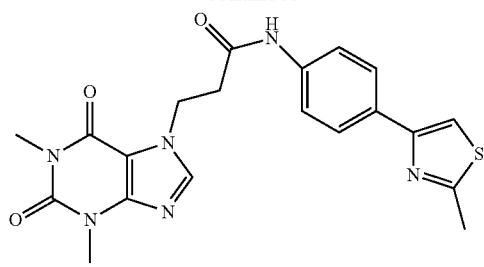
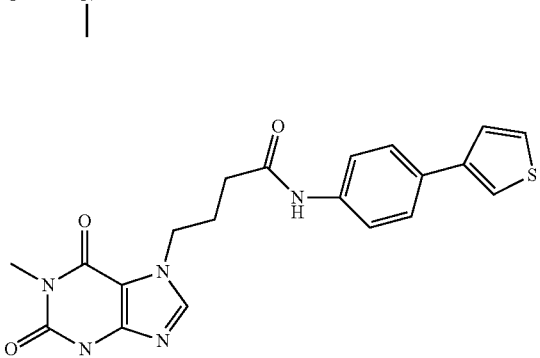
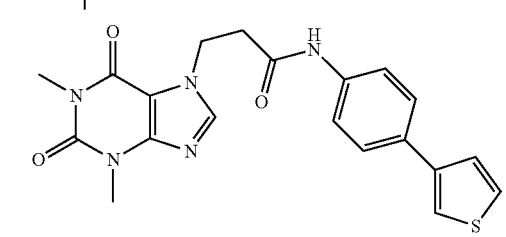
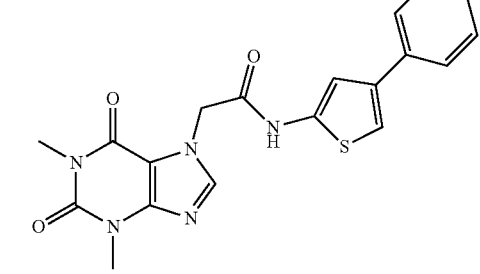
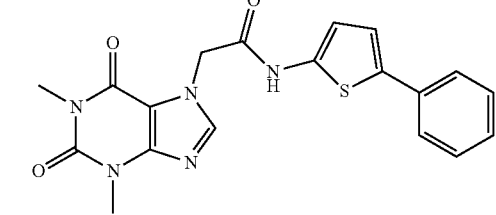

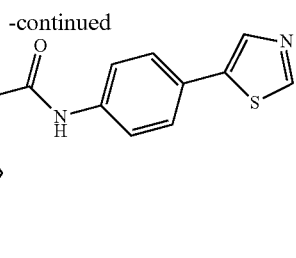

Exemplary, non-limiting embodiments of a Wnt inhibitor having structure (III) will now be disclosed. The present disclosure provides a Wnt inhibitor having structure (III):

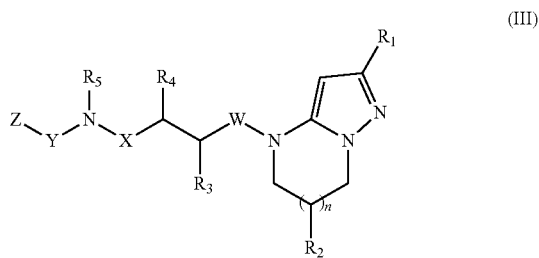

or a pharmaceutically acceptable salt, solvate or polymorph thereof, including all tautomers and stereoisomers thereof wherein:

$R_1$ may represent H; alkyl which is optionally substituted by one or more substituents each independently selected from $C_{1-6}$alkoxy, $NH_2$, —$NHC_{1-3}$alkyl and —$N(C_{1-3}$alkyl$)_2$; —C(O)Oalkyl; haloalkyl; haloalkoxy; or -alkylaryl;

each $R_2$ independently may represent H; alkyl which is optionally substituted by one or more substituents each independently selected from $C_{1-6}$alkoxy, $NH_2$, —$NHC_{1-3}$alkyl and —$N(C_{1-3}$alkyl$)_2$; -alkylaryl; carbocyclyl which is optionally substituted by one or more substituents each independently selected from $C_{1-6}$alkyl, $C_{1-6}$alkoxy, $C_{1-6}$haloalkyl, $C_{1-6}$haloalkoxy and halo; heterocyclyl which is optionally substituted by one or more substituents each independently selected from $C_{1-6}$alkyl, $C_{1-6}$alkoxy, —C(O)O$C_{1-6}$alkyl, —C(O)$C_{1-6}$alkyl and —C(O)NH$C_{1-6}$alkyl; —NHalkyl; —N(alkyl)$_2$; amino; hydroxyl; alkoxy or halo;

n may represent 0, 1 or 2;

$R_3$ may represent H or alkyl;

$R_4$ may represent H or alkyl;

$R_5$ may represent H or alkyl;

W and X each independently may represent C=O; C=S; or $CH_2$;

Y may represent aryl; heteroaryl; carbocyclyl which is optionally substituted by one or more substituents each independently selected from $C_{1-6}$alkyl, $C_{1-6}$alkoxy, $C_{1-6}$haloalkyl, $C_{1-6}$haloalkoxy and halo; or heterocyclyl which is optionally substituted by one or more substituents each independently selected from $C_{1-6}$alkyl, $C_{1-6}$alkoxy, —C(O)O$C_{1-6}$alkyl, —C(O)$C_{1-6}$alkyl and —C(O)NH$C_{1-6}$alkyl;

Y may further represent aryl or 6-membered monocyclic heteroaryl;

Z may represent alkyl which is optionally substituted by one or more substituents each independently selected from $C_{1-6}$alkoxy, $NH_2$, —$NHC_{1-3}$alkyl and —$N(C_{1-3}$alkyl$)_2$; aryl; heteroaryl; -alkylaryl; -alkylheterocyclyl; carbocyclyl which is optionally substituted by one or more substituents each independently selected from $C_{1-6}$alkyl, $C_{1-6}$alkoxy, $C_{1-6}$haloalkyl, $C_{1-6}$haloalkoxy and halo; heterocyclyl which is optionally substituted by one or more substituents each independently selected from $C_{1-6}$alkyl, $C_{1-6}$alkoxy, —C(O)O$C_{1-6}$alkyl, —C(O)$C_{1-6}$alkyl and —C(O)NH$C_{1-6}$alkyl; -alkylcarbocyclyl wherein carbocyclyl is optionally substituted by one or more substituents each independently selected from $C_{1-6}$alkyl, $C_{1-6}$alkoxy, $C_{1-6}$haloalkyl, $C_{1-6}$haloalkoxy and halo; -alkylheterocyclyl wherein heterocyclyl is optionally substituted by one or more substituents each independently selected from $C_{1-6}$alkyl, —C(O)O$C_{1-6}$alkyl, —C(O)$C_{1-6}$alkyl and —C(O)NH$C_{1-6}$alkyl; -arylcarbocyclyl wherein carbocyclyl is optionally substituted by one or more substituents each independently selected from $C_{1-6}$alkyl, $C_{1-6}$alkoxy, $C_{1-6}$haloalkyl, $C_{1-6}$haloalkoxy and halo; or -arylheterocyclyl wherein heterocyclyl is optionally substituted by one or more substituents each independently selected from $C_{1-6}$alkyl, —C(O)O$C_{1-6}$alkyl, —C(O)$C_{1-6}$alkyl and —C(O)NH$C_{1-6}$alkyl; and Z may further represent aryl or heteroaryl.

In the context of variable Y, the term "aryl" is understood to mean "arylene" (e.g. "phenyl" is understood to mean "phenylene" (i.e. $C_6H_4$)) because Y is a linking group, not a terminal group. The terms for other Y rings (e.g. heteroaryl) are to be construed likewise. When Y is referred to as being unsubstituted, this is understood to mean no other substituents other than Z and $NR_5$. When Y is referred to as being monosubstitued, this is understood to mean one substituent other than Z and $NR_5$.

When $R_1$ represents alkyl which is optionally substituted by one or more substituents each independently may be selected from $C_{1-6}$alkoxy, $NH_2$, —$NHC_{1-3}$alkyl and —$N(C_{1-3}$alkyl$)_2$ exemplary substituents include methoxy, —$NH_2$, —NHmethyl and —NH(methyl)$_2$. Examples include $C_{1-6}$ alkyl (e.g. unsubstituted $C_{1-6}$alkyl), for example methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). Exemplary $C_{1-6}$ alkyl groups are methyl and ethyl, particularly methyl.

When $R_1$ represents —C(O)Oalkyl, examples include —C(O)O$C_{1-6}$alkyl such as —C(O)OMe, —C(O)OEt, —C(O)OPr and —C(O)OiPr. A specific example is —C(O)OMe.

When $R_1$ represents haloalkyl, examples include $C_{1-6}$haloalkyl such as $CH_2F$, $CHF_2$, $CF_3$, $CH_2CH_2F$, $CH_2CHF_2$, $CH_2CF_3$, $CHFCH_3$ and $CF_2CH_3$. A specific example is $CF_3$.

When $R_1$ represents haloalkoxy, examples include $C_{1-6}$haloalkoxy such as $OCF_3$.

When $R_2$ represents alkyl which is optionally substituted by one or more substituents each independently may be selected from $C_{1-6}$alkoxy, $NH_2$, —$NHC_{1-3}$alkyl and —$N(C_{1-3}$alkyl$)_2$, exemplary substituents include methoxy, —$NH_2$, —NHmethyl and —NH(methyl)$_2$. Examples include $C_{1-6}$ alkyl (e.g. unsubstituted $C_{1-6}$alkyl), for example methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). An exemplary $C_{1-6}$ alkyl group is methyl.

When $R_2$ represents -alkylaryl, examples include benzyl.

When $R_2$ represents carbocyclyl which is optionally substituted by one or more substituents each independently may be selected from $C_{1-6}$alkyl (e.g. methyl), $C_{1-6}$alkoxy (e.g. methoxy), $C_{1-6}$haloalkyl (e.g. fluoromethyl such as trifluoromethyl), $C_{1-6}$haloalkoxy (e.g. fluoromethoxy such as trifluoromethoxy) and halo (e.g. fluoro, e.g. chloro), examples include $C_3$-$C_6$ cycloalkyl such as cyclopropyl, cyclobutyl, cyclopentyl and cyclohexyl. Substituted examples include cyclohexyl substituted by methyl.

When $R_2$ represents heterocyclyl which is optionally substituted by one or more substituents each independently may be selected from $C_{1-6}$alkyl, $C_{1-6}$alkoxy, —C(O)OC$_{1-6}$alkyl, —C(O)C$_{1-6}$alkyl and —C(O)NHC$_{1-6}$alkyl, Y may represent heterocyclyl which is optionally substituted by $C_{1-6}$ alkyl (such as methyl). Examples include monocyclic heterocyclyl. The heterocyclyl group may be unsubstituted or may have for example one or two (e.g. one) substituent (e.g. one methyl group). Examples include piperidinyl, morpholinyl, pyrrolidinyl, 4,5-dihydropyrazolyl and 4,5-dihydroisoxazolyl. A specific example is pyrrolidinyl.

When $R_2$ represents —NHalkyl, examples include —NHMe, NHEt, NHPr and NHiPr, in particular NHMe.

When $R_2$ represents —N(alkyl)$_2$, examples include —N(Me)$_2$.

When $R_2$ represents alkoxy, examples include methoxy and ethoxy, especially methoxy.

When n represents 1, examples of —(CHR$_2$)$_n$— include —CH$_2$— and —CH(CH$_3$)—.

When n represents 2, examples of —(CHR$_2$)$_n$— include —CH$_2$—CH$_2$—, —CH$_2$CH(CH$_3$)—, —CH(CH$_3$)CH$_2$— and —CH(CH$_3$)—CH(CH$_3$)—. An example of a —(CHR$_2$)$_2$— group is —CH$_2$—CH$_2$—.

When $R_3$ represents alkyl, examples include $C_{1-6}$ alkyl such as methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). An exemplary $C_{1-6}$ alkyl group is methyl.

When $R_4$ represents alkyl, examples include $C_{1-6}$ alkyl, for example methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). An exemplary $C_{1-6}$ alkyl group is methyl.

When $R_5$ represents alkyl, examples include $C_{1-6}$ alkyl such as methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). An exemplary $C_{1-6}$ alkyl group is methyl.

When Y represents aryl, examples include optionally substituted phenyl. Exemplary substituents include one or more (e.g. one or two, especially one) substituents each independently may be selected from $C_{1-6}$ alkyl (such as methyl), $C_{1-6}$alkoxy (such as methoxy), halo and $C_{1-6}$haloalkyl (such as fluoromethyl, e.g. trifluoromethyl). Examples include unsubstituted phenyl, methylphenyl, methoxyphenyl, fluorophenyl, chlorophenyl and trifluoromethylphenyl. Specific examples include unsubstituted phenyl. Specific examples also include methylphenyl, methoxyphenyl, fluorophenyl. Z and NR$_5$ may be positioned on the phenyl ring at the 1- and 4-positions relative to each other (i.e. Z and NR$_5$ have a para relationship).

When Y represents heteroaryl, examples include monocyclic (e.g. 5 and 6 membered) and bicyclic (e.g. 9 and 10 membered) heteroaryl rings, especially monocyclic heteroaryl rings, particularly 6-membered monocyclic heteroaryl rings. Examples of monocyclic heteroaryl may comprise one, two or three ring heteroatoms (e.g. one or two, e.g. one) including one or two nitrogen atoms (e.g. one or e.g. two) and optionally an oxygen or sulphur atom. Exemplary 5-membered monocyclic heteroaryl groups include pyrrolyl, pyrazolyl, imidazolyl, oxazolyl, isoxazolyl, thiazolyl, isothiazolyl, oxadiazolyl and thiadiazolyl. When Y is 5-membered monocyclic heteroaryl, Z and NR$_5$ may be positioned on the ring at non-adjacent ring atoms. Exemplary 6-membered monocyclic heteroaryl groups include pyridinyl. Exemplary 6-membered monocyclic heteroaryl groups also include pyridazinyl, pyrimidinyl and pyrazinyl. When Y is 6-membered monocyclic heteroaryl, Z and NR$_5$ may be positioned on the ring at 1- and 4-positions relative to each other (i.e. Z and NR$_5$ have a para relationship). The aforementioned heteroaryl group may either by unsubstituted or may be substituted by one or more (e.g. one or two, particularly one) substituents. Exemplary substituents are independently selected from $C_{1-6}$alkyl (such as methyl), $C_{1-6}$alkoxy (such as methoxy), halo (such as fluoro) and $C_{1-6}$haloalkyl (such as fluoromethyl, e.g. trifluoromethyl). When Y is unsubstituted heteroaryl, examples include isoxazolyl (e.g. isoxazolyl-5-yl (wherein NR$_5$ is at the 5-position and Z is at the 3-position) and isoxazolyl-3-yl (wherein NR$_5$ is at the 3-position and Z is at the 5-position), especially isoxazol-5-yl), oxadiazolyl, pyridinyl (e.g. pyridin-2-yl or pyridin-3-yl), pyridazinyl (e.g. pyridazin-3-yl), pyrimidinyl (e.g. pyrimidin-3-yl), pyrazinyl (e.g. pyrazin-2-yl). When Y is substituted heteroaryl, Y may for example be substituted by methyl or fluoro. When Y is substituted heteroaryl, examples include methylpyridinyl, fluoropyridinyl, methylpyridazinyl, methylpyrazinyl methylpyrimidinyl and 1-methylpyrazolyl.

When Y represents carbocyclyl which is optionally substituted by one or more substituents each independently may be selected from $C_{1-6}$alkyl (e.g. methyl), $C_{1-6}$alkoxy (e.g. methoxy), $C_{1-6}$haloalkyl (e.g. fluoromethyl such as trifluoromethyl), $C_{1-6}$haloalkoxy (e.g. fluoromethoxy) and halo (e.g. fluoro, e.g. chloro), Y may represent carbocyclyl which is optionally substituted by $C_{1-6}$alkyl. Examples include monocyclic carbocyclyl which is optionally substituted by $C_{1-6}$alkyl (such as methyl). Examples of carbocyclyl include $C_{3-8}$cycloalkyl (e.g. cyclohexyl) and $C_{5-8}$cycloalkenyl (e.g. cyclohexenyl). The carbocyclyl ring is optionally substituted by one, two or three independently may be selected substituents (e.g. one or two, especially one, e.g. one methyl group). When Y represents carbocyclyl, Y may represent $C_{3-8}$cycloalkyl, such as $C_{5-6}$cycloalkyl. A specific example is cyclohexyl. When Y is 6-membered carbocyclyl, Z and NR$_5$ are may be positioned on the carbocyclyl ring at the 1- and 4-positions relative to each other.

When Y represents heterocyclyl which is optionally substituted by one or more substituents each independently may be selected from $C_{1-6}$alkyl, $C_{1-6}$alkoxy, —C(O)OC$_{1-6}$alkyl, —C(O)C$_{1-6}$alkyl and —C(O)NHC$_{1-6}$alkyl, Y may represent heterocyclyl which is optionally substituted by $C_{1-6}$ alkyl (such as methyl). Examples include monocyclic heterocyclyl. The heterocyclyl group may be unsubstituted or may have for example one or two (e.g. one) substituent (e.g. one methyl group). Examples include piperidinyl, morpholinyl, pyrrolidinyl, 4,5-dihydropyrazolyl and 4,5-dihydroisoxazolyl. Specific examples include 4,5-dihydroisoxazolyl (e.g. 4,5-dihydroisoxazol-5-yl) and piperidinyl (e.g. piperidin-4-yl). When Y is 6-membered heterocyclyl, Z and NR$_5$ may be positioned on the heterocyclyl ring at the 1- and 4-positions relative to each other. When Y represents heterocyclyl, in one embodiment Z does not represent -alkylaryl.

When Z represents alkyl which is optionally substituted by one or more substituents each independently may be selected from $C_{1-6}$alkoxy, NH$_2$, —NHC$_{1-3}$alkyl and —N(C$_{1-3}$alkyl)$_2$, exemplary substituents include methoxy, —NH$_2$, —NHmethyl and —NH(methyl)$_2$. Examples include $C_{1-6}$alkyl (e.g. unsubstituted $C_{1-6}$alkyl), for example methyl, ethyl, propyl (e.g. n-propyl, isopropyl), butyl (e.g. n-butyl, iso-butyl, sec-butyl, tert-butyl), pentyl (e.g. n-pentyl) and hexyl (e.g. n-hexyl). Examples also include $C_{3-6}$alkyl (e.g. unsubstituted $C_{3-6}$alkyl), for example propyl (e.g. n-propyl, isopropyl), butyl (e.g. n-butyl, iso-butyl, sec-butyl, tert-butyl), pentyl (e.g. n-pentyl) and hexyl (e.g. n-hexyl). Exemplary $C_{1-6}$ alkyl groups are methyl and tert-butyl.

When Z represents aryl, examples include optionally substituted phenyl. Exemplary substituents include one or more (e.g. one or two, especially one) substituents each independently may be selected from fluoro, chloro, bromo, amino, methoxy, methyl, haloalkyl (e.g. fluoromethyl such as trifluoromethyl), —COOH, —C(O)NMe$_2$, dimethylamino and —NHC(O)Me. Examples include unsubstituted phenyl. Substituted examples include fluorophenyl (e.g. 2-fluorophenyl, 3-fluorophenyl and 4-fluorophenyl), chlorophenyl (e.g. 2-chlorophenyl, 3-chlorophenyl, 4-chlorophenyl and 3,4-dichlorophenyl), bromophenyl (e.g. 2-bromophenyl, 3-bromophenyl and 4-bromophenyl), aminophenyl (e.g. 2-aminophenyl, 3-aminophenyl, 4-aminophenyl), methoxyphenyl (e.g. 2-methoxyphenyl, 3-methoxyphenyl and 4-methoxyphenyl), methylphenyl (e.g. 2-methylphenyl, 3-methylphenyl and 4-methylphenyl), fluoromethylphenyl (e.g. 3-trifluoromethylphenyl and 4-trifluoromethylphenyl), carboxyphenyl (e.g. 3-(COOH)-phenyl), 3-(C(O)NMe$_2$)-phenyl), 3-dimethylaminophenyl and 3-(NHC(O)Me)-phenyl.

When Z represents heteroaryl, examples include monocyclic (e.g. 5 and 6 membered) and bicyclic (e.g. 9 and 10 membered) heteroaryl rings, especially monocyclic rings. Examples of monocyclic heteroaryl comprise one, two or three ring heteroatoms (e.g. one or two, e.g. one) including one or two nitrogen atoms (e.g. one or e.g. two) and optionally an oxygen or sulphur atom. Exemplary 5-membered monocyclic heteroaryl groups include pyrrolyl, pyrazolyl, imidazolyl, oxazolyl, isoxazolyl, thiazolyl, isothiazolyl, oxadiazolyl and thiadiazolyl. Exemplary 6-membered monocyclic heteroaryl groups include pyridinyl. Exemplary 6-membered monocyclic heteroaryl groups also include pyridazinyl, pyrimidinyl and pyrazinyl. The aforementioned heteroaryl group may either by unsubstituted or may be substituted by one or more (e.g. one or two, particularly one) substituents. Exemplary substituents are independently selected from methyl, fluoro, chloro, amino, halomethyl (e.g. fluoromethyl such as trifluoromethyl). Unsubstituted examples include pyridinyl (e.g. pyridin-2-yl, pyridin-3-yl and pyridin-4-yl), pyrazinyl (e.g. pyrazin-2-yl), pyridazinyl (e.g. pyridazin-3-yl), pyrimidinyl (e.g. pyrimidin-2-yl, pyrimidin-4-yl and pyrimidin-5-yl), oxazolyl (e.g. oxazol-2-yl and oxazol-5-yl), thiazolyl (e.g. thiazol-2-yl and thiazole-5-yl) and pyrazolyl (e.g. pyrazol-1-yl). Substituted examples include chloropyridinyl (e.g. 4-chloropyridin-2-yl, 5-chloropyridin-2-yl and 5-chloropyridin-3-yl), fluoropyridinyl (e.g. 4-fluoropyridin-2-yl, 5-fluoropyridin-2-yl and 5-fluoropyridin-3-yl), methylpyridinyl (e.g. 2-methylpyridin-5-yl, 6-methylpyridin-2-yl and 5-methylpyridin-3-yl), fluoromethylpyridinyl (e.g. 5-trifluoromethylpyridin-3-yl), aminopyridinyl (e.g. 5-aminopyridin-3-yl), methylpyrazinyl (e.g. 5-methylpyrazin-2-yl), methylthiazolyl (e.g. 2-methylthiazol-4-yl) and methylpyrazolyl (e.g. 1-methylpyrazol-5-yl).

When Z represents -alkylaryl, examples include benzyl.

When Z represents -alkylheteroaryl (e.g. —CH$_2$-heteroaryl), examples include -alkylpyrrolyl, -alkylpyrazolyl, -alkylimidazolyl, -alkyloxazolyl, -alkylisoxazolyl, -alkylthiazolyl, -alkylisothiazolyl, -alkyloxadiazolyl, -alkylthiadiazolyl, -alkylpyridinyl, -alkylpyridazinyl, -alkylpyrimidinyl and -alkylpyrazinyl.

When Z represents carbocyclyl which is optionally substituted by one or more substituents each independently may be selected from $C_{1-6}$alkyl (e.g. methyl), $C_{1-6}$alkoxy (e.g. methoxy), $C_{1-6}$haloalkyl (e.g. fluoromethyl), $C_{1-6}$haloalkoxy (e.g. fluoromethoxy) and halo (e.g. fluoro, e.g. chloro), Z may represent carbocyclyl which is optionally substituted by $C_{1-6}$ alkyl. Examples include monocyclic carbocyclyl which is optionally substituted by $C_1{}^-{}_6$ alkyl (such as methyl). Examples of carbocyclyl include $C_{3-8}$cycloalkyl (e.g. cyclohexyl) and $C_{5-8}$cycloalkenyl (e.g. cyclohexenyl). The carbocyclyl ring may be optionally substituted by one, two or three substituents (e.g. one or two, especially one, e.g. one methyl group). When Z represents carbocyclyl, Z may represent $C_{3-8}$cycloalkyl, such as $C_{5-6}$cycloalkyl. A specific example is cyclohexyl.

When Z represents heterocyclyl which is optionally substituted by one or more substituents each independently may be selected from $C_{1-6}$alkyl, $C_{1-6}$alkoxy, —C(O)OC$_{1-6}$alkyl, —C(O)C$_{1-6}$alkyl, —C(O)NHC$_{1-6}$alkyl C$_{1-6}$alkyl (e.g. methyl), —C(O)OC$_{1-6}$alkyl (e.g. —C(O)Omethyl), —C(O)C$_{1-6}$alkyl (e.g. —C(O)methyl), —C(O)NHC$_{1-6}$alkyl (e.g. —C(O)NHmethyl), examples include unsubstituted heterocyclyl and heterocyclyl with one or two (e.g. one) substituent. Examples include heterocyclyl groups containing one nitrogen atom (such as pyrrolidinyl and piperidinyl) or two nitrogen atoms (such as piperazinyl). Examples also include heterocyclyl groups containing one nitrogen atom and one oxygen atom (e.g. morpholinyl) or one sulfur atom (e.g. thiomorpholinyl). In one example when Z is substituted, a ring nitrogen atom may be substituted. Substituted examples include substituted piperazinyl, such as 4-substituted piperazinyl, e.g. 4-Boc-piperazinyl, 4-(C(O)Me)-piperazinyl, 4-(C(O)NHEt)piperazinyl and 4-methylpiperazinyl.

When Z represents -alkylcarbocyclyl (e.g. —CH$_2$-carbocyclyl) wherein carbocyclyl is optionally substituted by one or more substituents each independently may be selected from $C_{1-6}$alkyl (e.g. methyl), $C_{1-6}$haloalkyl (e.g. fluoromethyl such as trifluoromethyl), $C_{1-6}$alkoxy (e.g. methoxy), $C_{1-6}$haloalkoxy (e.g. fluoromethoxy) and halo (e.g. fluoro, e.g. chloro), examples include —CH$_2$-cyclopropyl and —CH$_2$-cyclobutyl.

When Z represents -alkylheterocyclyl wherein heterocyclyl is optionally substituted by one or more substituents each independently may be selected from $C_{1-6}$alkyl, —C(O)OC$_{1-6}$alkyl, —C(O)C$_{1-6}$alkyl, —C(O)NHC$_{1-6}$alkyl C$_{1-6}$alkyl (e.g. methyl), —C(O)OC$_{1-6}$alkyl (e.g. —C(O)Omethyl), —C(O)C$_{1-6}$alkyl (e.g. —C(O)methyl), —C(O)NHC$_{1-6}$alkyl (e.g. —C(O)NHmethyl), examples include —CH$_2$-heterocyclyl, such as —CH$_2$-morpholinyl, —CH$_2$— piperazinyl, —CH$_2$-piperidinyl and —CH$_2$-pyrrolidinyl.

When Z represents -arylcarbocyclyl wherein carbocyclyl is optionally substituted by one or more substituents each independently may be selected from $C_{1-6}$alkyl (e.g. methyl), $C_{1-6}$alkoxy (e.g. methoxy), $C_{1-6}$haloalkyl (e.g. fluoromethyl such as trifluoromethyl), $C_{1-6}$haloalkoxy (e.g. fluoromethoxy) and halo (e.g. fluoro, e.g. chloro), Z may be phenylcarbocyclyl. The carbocyclyl ring may be unsubstituted or may be substituted by one or more $C_{1-6}$alkyl groups. The carbocyclyl ring may be monocyclic. An exemplary carbocyclyl ring is cycloalkyl. Examples include cyclopropylphenyl- and cyclohexylphenyl-.

When Z represents -arylheterocyclyl wherein heterocyclyl is optionally substituted by one or more substituents each independently may be selected from $C_{1-6}$alkyl, $C_{1-6}$alkoxy, —C(O)OC$_{1-6}$alkyl, —C(O)C$_{1-6}$alkyl, —C(O)NHC$_{1-6}$alkyl C$_{1-6}$alkyl (e.g. methyl), —C(O)OC$_{1-6}$alkyl (e.g. —C(O)Omethyl), —C(O)C$_{1-6}$alkyl (e.g. —C(O)methyl), —C(O)NHC$_{1-6}$alkyl (e.g. —C(O)NHmethyl), Z may be -phenylheterocyclyl. The heterocyclyl ring may be monocyclic and may contain one or two (e.g. one) nitrogen atoms. Examples include morpholinolylphenyl-, piperazinylphenyl-, piperidinylphenyl-, pyrrolidinylphenyl-. A specific example is 3-(morpholin-4-yl)phenyl-.

Suitably $R_1$ may represent H, methyl, ethyl, —C(O)OMe, $CF_3$ or OMe. In one example $R_1$ represents methyl.

Suitably each $R_2$ independently may represent H or alkyl. More suitably $R_2$ represents H or methyl. In one example, $R_2$ represents H. In one example $R_2$ represents methyl.

Suitably n may represent 0 or 1, for example n represents 1.

Suitably $R_3$ may represent H or methyl, for example $R_3$ represents H.

Suitably $R_4$ may represent H or methyl, for example $R_4$ represents H.

Suitably $R_5$ may represent H or methyl, for example $R_5$ represents H.

Suitably W and X are the same as each other.

Suitably W and X each may represent C=O.

Suitably Y may represent aryl (e.g. phenyl) or heteroaryl (e.g. 5- or 6-membered monocyclic heteroaryl comprising one, two or three ring heteroatoms including one or two nitrogen atoms such as isoxazolyl, pyridinyl, pyridazinyl, pyrimidinyl or pyrazinyl). In one example Y represents phenyl. In one example Y represents monocyclic heteroaryl. In one example Y is substituted by one or more substituents each independently selected from $C_{1-6}$ alkyl, $C_{1-6}$alkoxy, halo and $C_{1-6}$haloalkyl. In one example Y is unsubstituted. In one example Y is monosubstituted. When Y is 5-membered, suitably Z and $NR_5$ are positioned on the ring at non-adjacent ring atoms. When Y is 6-membered, suitably Z and $NR_5$ are positioned on the ring at 1- and 4-positions relative to each other (i.e. Z and $NR_5$ have a para relationship).

Suitably Z may represent aryl (e.g. phenyl) or heteroaryl (for example 6-membered heteroaryl such as pyridinyl, pyridazinyl, pyrimidinyl or pyrazinyl especially pyridinyl; or 5-membered heteroaryl such as oxazolyl, thiazolyl, pyrazolyl). In one example Z represents heteroaryl. In one example Z represents aryl. In one example, Z does not represent methyl or ethyl. In one example Z does not represent unsubstituted alkyl.

The present disclosure provides Wnt inhibitors having the structure (III), which are compounds of formula (IIIA):

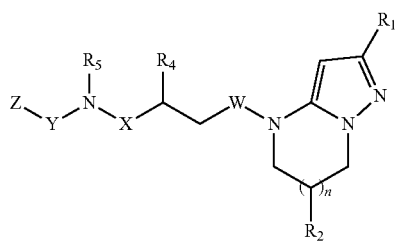

(IIIA)

or a pharmaceutically acceptable salt, solvate or polymorph thereof, including all tautomers and stereoisomers thereof wherein:

$R_1$ may represent alkyl;

each $R_2$ independently may represent H, alkyl, carbocyclyl which may be optionally substituted by one or more substituents each independently selected from $C_{1-6}$alkyl, $C_{1-6}$alkoxy, $C_{1-6}$haloalkoxy and halo, —NHalkyl, —N(alkyl)$_2$, amino, hydroxyl, alkoxy or halo;

n may represent 0, 1 or 2;

$R_4$ may represent H or alkyl;

$R_5$ may represent H or alkyl;

W and X each independently may represent C=O or C=S (in some examples, W and X are both C=O);

Y may represent aryl; heteroaryl; carbocyclyl which is optionally substituted by one or more substituents each independently selected from $C_{1-6}$alkyl, $C_{1-6}$alkoxy, $C_{1-6}$haloalkyl, $C_{1-6}$haloalkoxy and halo; or heterocyclyl which is optionally substituted by one or more substituents each independently selected from $C_{1-6}$alkyl, —C(O)OC$_{1-6}$alkyl, —C(O)C$_{1-6}$alkyl and —C(O)NHC$_{1-6}$alkyl; and Z may represent alkyl; aryl; heteroaryl; carbocyclyl which is optionally substituted by one or more substituents each independently selected from $C_{1-6}$alkyl, $C_{1-6}$alkoxy, $C_{1-6}$haloalkoxy (e.g. fluoromethoxy) $C_{1-6}$haloalkoxy and halo; heterocyclyl which is optionally substituted by one or more substituents each independently selected from $C_{1-6}$alkyl, —C(O)OC$_{1-6}$alkyl, —C(O)C$_{1-6}$alkyl and —C(O)NHC$_{1-6}$alkyl; -arylcarbocyclyl wherein carbocyclyl which is optionally substituted by one or more substituents each independently selected from $C_{1-6}$alkyl, $C_{1-6}$alkoxy, $C_{1-6}$haloalkoxy and halo; or -arylheterocyclyl wherein heterocyclyl which is optionally substituted by one or more substituents each independently selected from $C_{1-6}$alkyl, —C(O)OC$_{1-6}$alkyl, —C(O)C$_{1-6}$alkyl and —C(O)NHC$_{1-6}$alkyl.

In one example, Wnt inhibitors having structure (III) are provided in which $R_1$ represents methyl; $R_2$ represents H; n represents 1; W and X each represent C=O; $R_3$ represents H; $R_4$ represents H; Y represents isoxazolyl; and Z represents phenyl which is optionally substituted by chloro, fluoro, bromo, methyl or methoxy.

In one example, Wnt inhibitors having structure (III) are provided in which $R_1$ represents methyl; $R_2$ represents H; n represents 1; W and X each represent C=O; $R_3$ represents H; $R_4$ represents H; Y represents phenyl; and Z represents phenyl which is optionally substituted by fluoro, chloro, amino, methyl or methoxy.

In one example, Wnt inhibitors having structure (III) are provided in which $R_1$ represents methyl; $R_2$ represents H; n represents 1; W and X each represent C=O; $R_3$ represents H; $R_4$ represents H; Y represents pyridinyl; and Z represents pyridinyl which is optionally substituted by fluoro, chloro, methyl, amino or trifluoromethyl.

In one example, Wnt inhibitors having structure (III) are provided in which $R_1$ represents methyl; $R_2$ represents H; n represents 1; W and X each represent C=O; $R_3$ represents H; $R_4$ represents H; Y represents pyridazinyl, pyrimidinyl or pyrazinyl; and Z represents pyridinyl which is optionally substituted by fluoro, chloro, methyl, amino or trifluoromethyl.

In one example, $R_2$, $R_4$ and $R_5$ are all H, n=1 and W and X are both C=O.

In a further example, there may be provided 4-(2-methyl-6,7-dihydropyrazolo[1,5-a]pyrimidin-4(5H)-yl)-4-oxo-N-(6-(pyridin-3-yl)pyridazin-3-yl)butanamide of structure (III). Compound 51 (ETC-569) of structure (III) having the compound name 4-(2-methyl-6,7-dihydropyrazolo[1,5-a]pyrimidin-4(5H)-yl)-4-oxo-N-(6-(pyridin-3-yl)pyridazin-3-yl)butanamide, may also be known as a compound of the structure (V) as defined thereafter.

In one example, Z is not phenyl substituted by trifluoroalkyl.

In one example, when Y is isoxazolyl, Z is not positioned at the 4-position of the isoxazolyl ring.

Specific (but non-limiting) examples of the compounds of the Wnt inhibitor having structure (III) are set out below:

| Cpd ID | Structure | IUPAC Name |
|---|---|---|
| 1 | 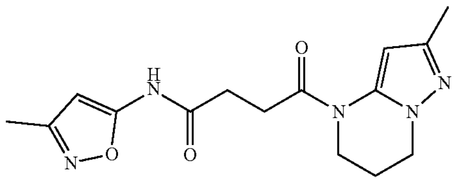 | 4-(2-methyl-6,7-dihydropyrazolo[1,5-a]pyrimidin-4(5H)-yl)-N-(3-methylisoxazol-5-yl)-4-oxobutanamide |
| 2 | 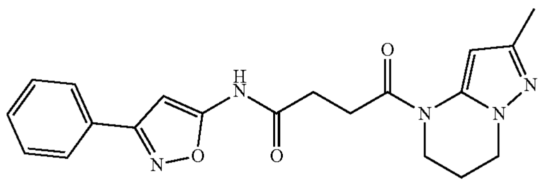 [SMILES: Cc1cc2n(n1)CCCN2C(=O)CCC(=O)Nc1cc(-c2ccccc2)no1] | 4-(2-methyl-6,7-dihydropyrazolo[1,5-a]pyrimidin-4(5H)-yl)-4-oxo-N-(3-phenylisoxazol-5-yl)butanamide |
| 3 | 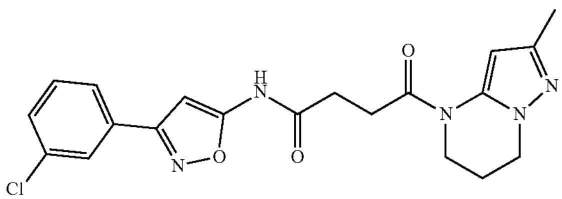 [SMILES: Cc1cc2n(n1)CCCN2C(=O)CCC(=O)Nc1cc(-c2cccc(Cl)c2)no1] | N-(3-(3-chlorophenyl)isoxazol-5-yl)-4-(2-methyl-6,7-dihydropyrazolo[1,5-a]pyrimidin-4(5H)-yl)-4-oxobutanamide |
| 4 | 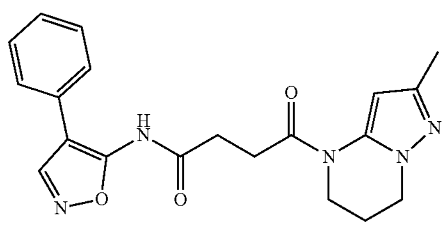 [SMILES: Cc1cc2n(n1)CCCN2C(=O)CCC(=O)Nc1oncc1-c1ccccc1] | 4-(2-methyl-6,7-dihydropyrazolo[1,5-a]pyrimidin-4(5H)-yl)-4-oxo-N-(4-phenylisoxazol-5-yl)butanamide |
| 5 | 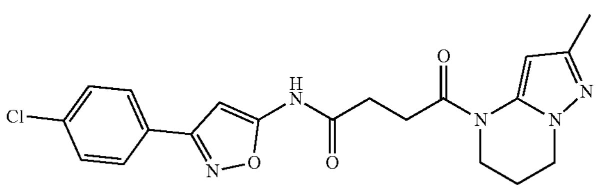 [SMILES: Cc1cc2n(n1)CCCN2C(=O)CCC(=O)Nc1cc(-c2ccc(Cl)cc2)no1] | N-(3-(4-chlorophenyl)isoxazol-5-yl)-4-(2-methyl-6,7-dihydropyrazolo[1,5-a]pyrimidin-4(5H)-yl)-4-oxobutanamide |
| 6 | 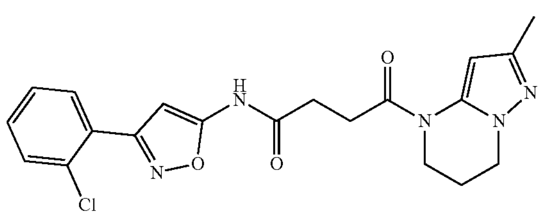 [SMILES: Cc1cc2n(n1)CCCN2C(=O)CCC(=O)Nc1cc(-c2ccccc2Cl)no1] | N-(3-(2-chlorophenyl)isoxazol-5-yl)-4-(2-methyl-6,7-dihydropyrazolo[1,5-a]pyrimidin-4(5H)-yl)-4-oxobutanamide |
| 7 | 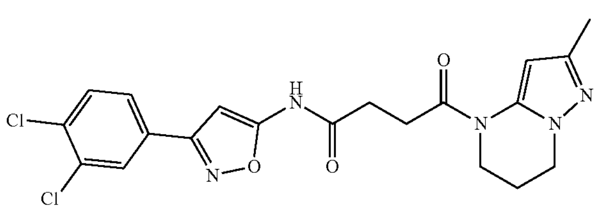 [SMILES: Cc1cc2n(n1)CCCN2C(=O)CCC(=O)Nc1cc(-c2ccc(Cl)c(Cl)c2)no1] | N-(3-(3,4-dichlorophenyl)isoxazol-5-yl)-4-(2-methyl-6,7-dihydropyrazolo[1,5-a]pyrimidin-4(5H)-yl)-4-oxobutanamide |

| Cpd ID | Structure | IUPAC Name |
| --- | --- | --- |
| 8 | 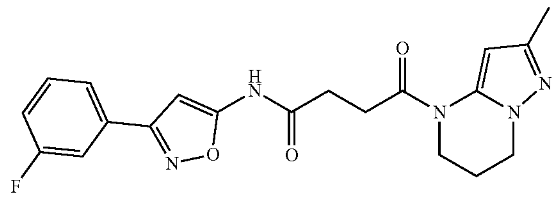 [SMILES: Cc1cc2n(n1)CCCN2C(=O)CCC(=O)Nc1cc(-c2cccc(F)c2)no1] | N-(3-(3-fluorophenyl)isoxazol-5-yl)-4-(2-methyl-6,7-dihydropyrazolo[1,5-a]pyrimidin-4(5H)-yl)-4-oxobutanamide |
| 9 | 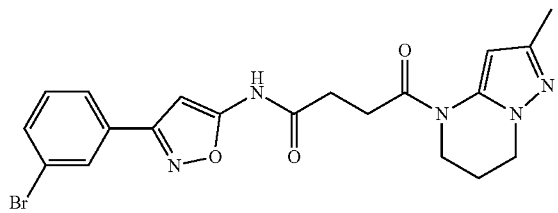 | N-[3-(3-bromophenyl)-1,2-oxazol-5-yl]-4-{2-methyl-5H,6H,7H-pyrazolo[1,5-a]pyrimidin-4-yl}-4-oxobutanamide |
| 10 | 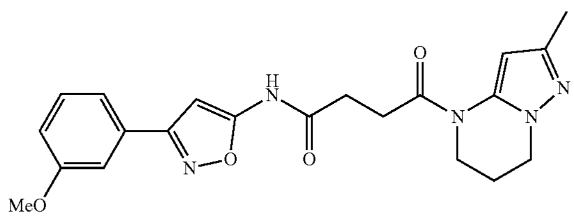 [SMILES: COc1cccc(-c2cc(NC(=O)CCC(=O)N3CCCn4nc(C)cc43)on2)c1] | N-[3-(3-methoxyphenyl)-1,2-oxazol-5-yl]-4-{2-methyl-5H,6H,7H-pyrazolo[1,5-a]pyrimidin-4-yl}-4-oxobutanamide |
| 11 | 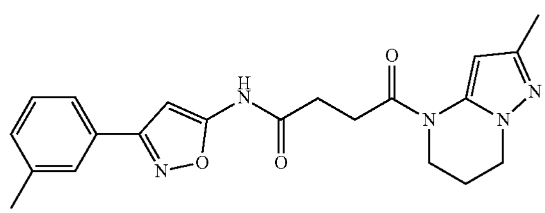 [SMILES: Cc1cccc(-c2cc(NC(=O)CCC(=O)N3CCCn4nc(C)cc43)on2)c1] | 4-{2-methyl-5H,6H,7H-pyrazolo[1,5-a]pyrimidin-4-yl}-N-[3-(3-methylphenyl)-1,2-oxazol-5-yl]-4-oxobutanamide |
| 12 | 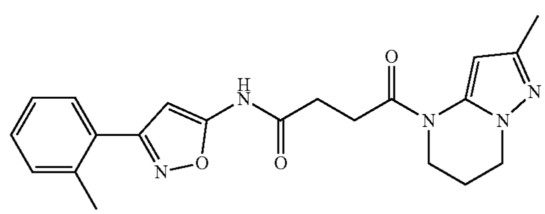 [SMILES: Cc1cc2n(n1)CCCN2C(=O)CCC(=O)Nc1cc(-c2ccccc2C)no1] | 4-(2-methyl-6,7-dihydropyrazolo[1,5-a]pyrimidin-4(5H)-yl)-4-oxo-N-(3-(o-tolyl)isoxazol-5-yl)butanamide |
| 13 | 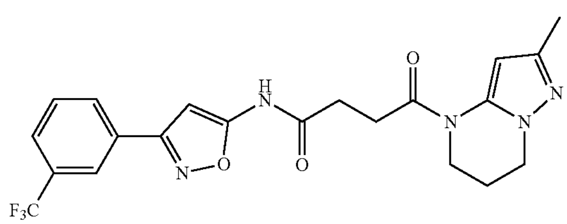 [SMILES: Cc1cc2n(n1)CCCN2C(=O)CCC(=O)Nc1cc(-c2cccc(C(F)(F)F)c2)no1] | 4-{2-methyl-5H,6H,7H-pyrazolo[1,5-a]pyrimidin-4-yl}-4-oxo-N-{3-[3-(trifluoromethyl)phenyl]-1,2-oxazol-5-yl}butanamide |
| 14 | 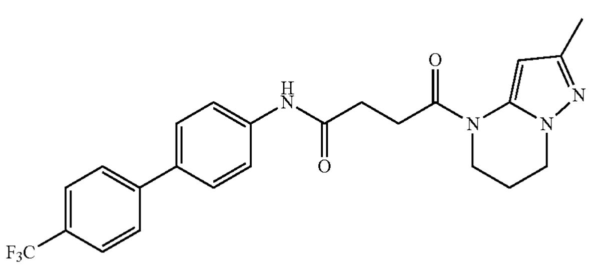 [SMILES: Cc1cc2n(n1)CCCN2C(=O)CCC(=O)Nc1ccc(-c2ccc(C(F)(F)F)cc2)cc1] | 4-(2-methyl-6,7-dihydropyrazolo[1,5-a]pyrimidin-4(5H)-yl)-4-oxo-N-(4'-(trifluoromethyl)-[1,1'-biphenyl]-4-yl)butanamide |

| Cpd ID | Structure | IUPAC Name |
|---|---|---|
| 15 | 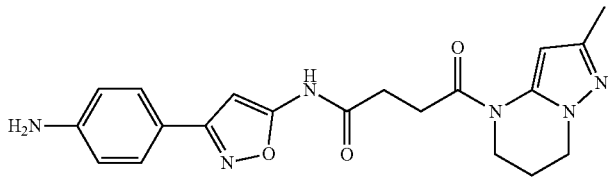 [SMILES: Cc1cc2n(n1)CCCN2C(=O)CCC(=O)Nc1cc(-c2ccc(N)cc2)no1] | N-[3-(4-aminophenyl)-1,2-oxazol-5-yl]-4-{2-methyl-5H,6H,7H-pyrazolo[1,5-a]pyrimidin-4-yl}-4-oxobutanamide |
| 16 | 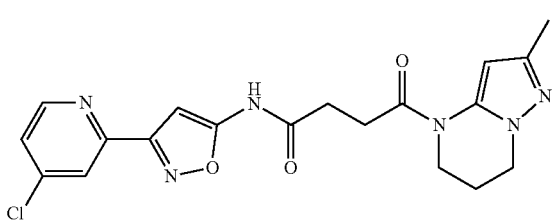 [SMILES: Cc1cc2n(n1)CCCN2C(=O)CCC(=O)Nc1cc(-c2cc(Cl)ccn2)no1] | N-(3-(4-chloropyridin-2-yl)isoxazol-5-yl)-4-(2-methyl-6,7-dihydropyrazolo[1,5-a]pyrimidin-4(5H)-yl)-4-oxobutanamide |
| 17 | 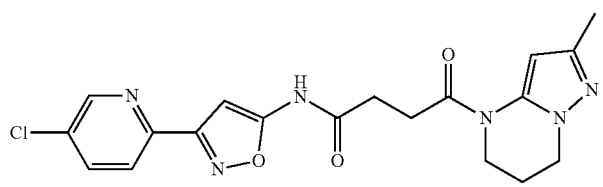 [SMILES: Cc1cc2n(n1)CCCN2C(=O)CCC(=O)Nc1cc(-c2ccc(Cl)cn2)no1] | N-(3-(5-chloropyridin-2-yl)isoxazol-5-yl)-4-(2-methyl-6,7-dihydropyrazolo[1,5-a]pyrimidin-4(5H)-yl)-4-oxobutanamide |
| 18 | 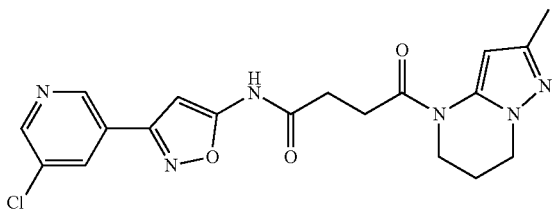 [SMILES: Cc1cc2n(n1)CCCN2C(=O)CCC(=O)Nc1cc(-c2cncc(Cl)c2)no1] | N-[3-(5-chloropyridin-3-yl)-1,2-oxazol-5-yl]-4-{2-methyl-5H,6H,7H-pyrazolo[1,5-a]pyrimidin-4-yl}-4-oxobutanamide |
| 19 | 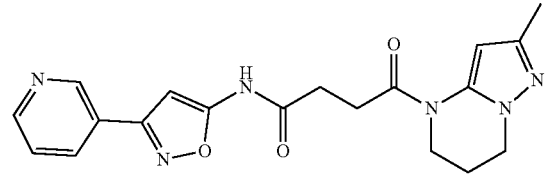 [SMILES: Cc1cc2n(n1)CCCN2C(=O)CCC(=O)Nc1cc(-c2cccnc2)no1] | 4-(2-methyl-6,7-dihydropyrazolo[1,5-a]pyrimidin-4(5H)-yl)-4-oxo-N-(3-(pyridin-3-yl)isoxazol-5-yl)butanamide |
| 20 | 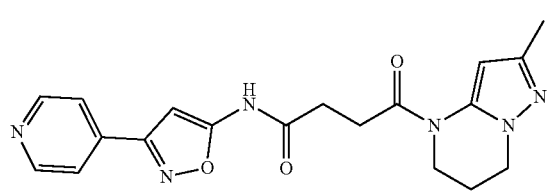 [SMILES: Cc1cc2n(n1)CCCN2C(=O)CCC(=O)Nc1cc(-c2ccncc2)no1] | 4-{2-methyl-5H,6H,7H-pyrazolo[1,5-a]pyrimidin-4-yl}-4-oxo-N-[3-(pyridin-4-yl)-1,2-oxazol-5-yl]butanamide |
| 21 | 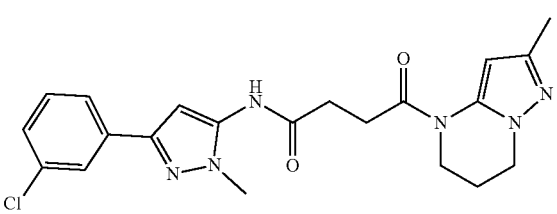 [SMILES: Cc1cc2n(n1)CCCN2C(=O)CCC(=O)Nc1cc(-c2cccc(Cl)c2)nn1C] | N-(3-(3-chlorophenyl)-1-methyl-1H-pyrazol-5-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 22 | 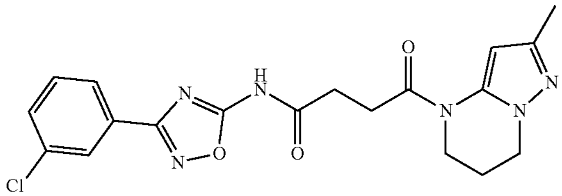 | N-(3-(3-chlorophenyl)-1,2,4-oxadiazol-5-yl)-4-(2-methyl-6,7-dihydropyrazolo[1,5-a]pyrimidin-4(5H)-yl)-4-oxobutanamide |
| 23 | 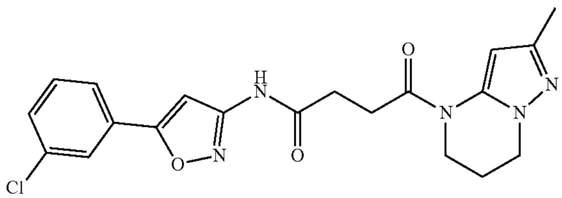 [SMILES: Cc1cc2n(n1)CCCN2C(=O)CCC(=O)Nc1cc(-c2cccc(Cl)c2)on1] | N-[5-(3-chlorophenyl)-1,2-oxazol-3-yl]-4-{2-methyl-5H,6H,7H-pyrazolo[1,5-a]pyrimidin-4-yl}-4-oxobutanamide |
| 24 | 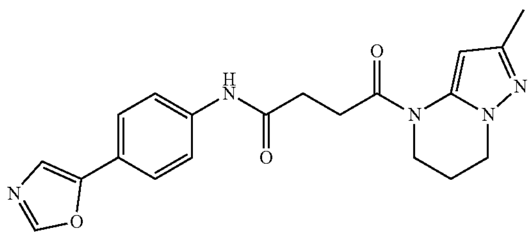 [SMILES: Cc1cc2n(n1)CCCN2C(=O)CCC(=O)Nc1ccc(-c2cnco2)cc1] | 4-(2-methyl-6,7-dihydropyrazolo[1,5-a]pyrimidin-4(5H)-yl)-N-(4-(oxazol-5-yl)phenyl)-4-oxobutanamide |
| 25 | 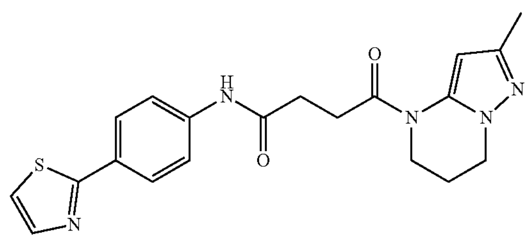 [SMILES: Cc1cc2n(n1)CCCN2C(=O)CCC(=O)Nc1ccc(-c2nccs2)cc1] | 4-(2-methyl-6,7-dihydropyrazolo[1,5-a]pyrimidin-4(5H)-yl)-N-(4-(oxazol-5-yl)phenyl)-4-oxobutanamide |
| 26 | 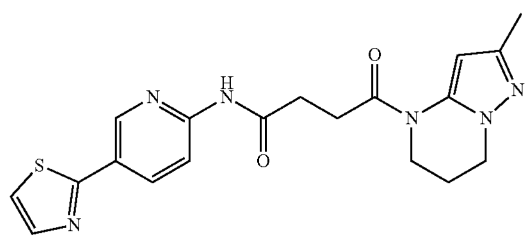 [SMILES: Cc1cc2n(n1)CCCN2C(=O)CCC(=O)Nc1ccc(-c2nccs2)cn1] | 4-(2-methyl-6,7-dihydropyrazolo[1,5-a]pyrimidin-4(5H)-yl)-4-oxo-N-(5-(thiazol-2-yl)pyridin-2-yl)butanamide |
| 27 | 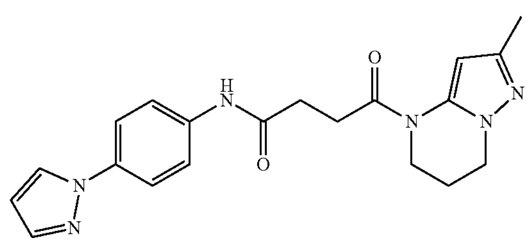 [SMILES: Cc1cc2n(n1)CCCN2C(=O)CCC(=O)Nc1ccc(-n2cccn2)cc1] | N-(4-(1H-imidazol-1-yl)phenyl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 28 | 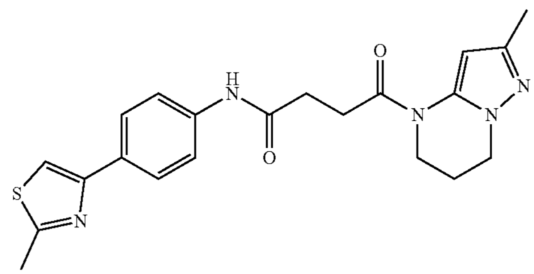 [SMILES: Cc1cc2n(n1)CCCN2C(=O)CCC(=O)Nc1ccc(-c2csc(C)n2)cc1] | 4-(2-methyl-6,7-dihydropyrazolo[1,5-a]pyrimidin-4(5H)-yl)-N-(4-(2-methylthiazol-4-yl)phenyl)-4-oxobutanamide |
| 29 | 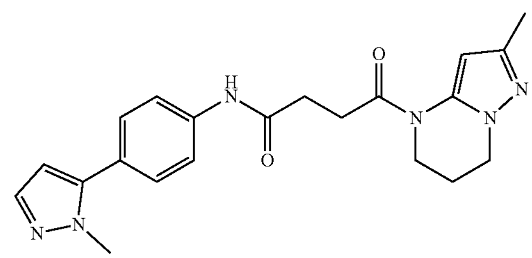 [SMILES: Cc1cc2n(n1)CCCN2C(=O)CCC(=O)Nc1ccc(-c2ccnn2C)cc1] | N-(4-(1-methyl-1H-pyrazol-5-yl)phenyl)-4-(2-methyl-6,7-dihydropyrazolo[1,5-a]pyrimidin-4(5H)-yl)-4-oxobutanamide |
| 30 | 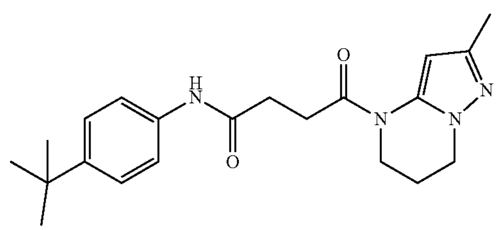 [SMILES: Cc1cc2n(n1)CCCN2C(=O)CCC(=O)Nc1ccc(C(C)(C)C)cc1] | N-(4-tert-butyl)phenyl)-4-(2-methyl-6,7-dihydropyrazolo[1,5-a]pyrimidin-4(5H)-yl)-4-oxobutanamide |
| 31 | 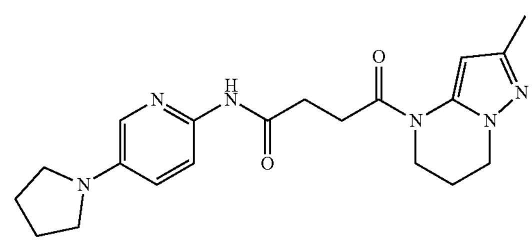 [SMILES: Cc1cc2n(n1)CCCN2C(=O)CCC(=O)Nc1ccc(N2CCCC2)cn1] | 4-(2-methyl-6,7-dihydropyrazolo[1,5-a]pyrimidin-4(5H)-yl)-4-oxo-N-(4-(pyrrolidin-1-yl)phenyl)butanamide |
| 32 | 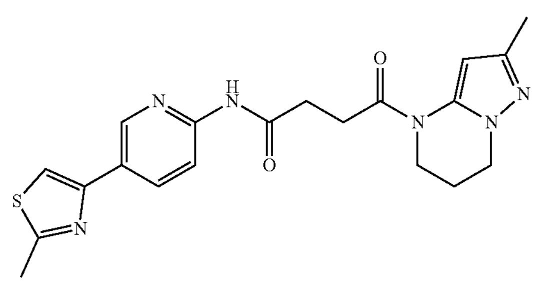 [SMILES: Cc1cc2n(n1)CCCN2C(=O)CCC(=O)Nc1ccc(-c2csc(C)n2)cn1] | 4-(2-methyl-6,7-dihydropyrazolo[1,5-a]pyrimidin-4(5H)-yl)-N-(4-(2-methylthiazol-4-yl)phenyl)-4-oxobutanamide |
| 33 | 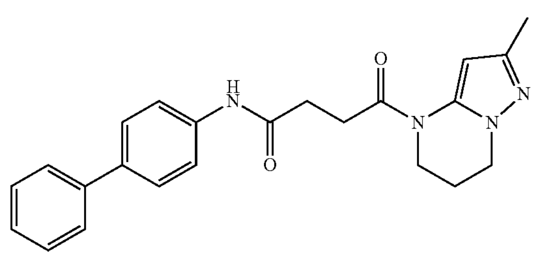 [SMILES: Cc1cc2n(n1)CCCN2C(=O)CCC(=O)Nc1ccc(-c2ccccc2)cc1] | N-([1,1'-biphenyl]-4-yl)-4-(2-methyl-6,7-dihydropyrazolo[1,5-a]pyrimidin-4(5H)-yl)-4-oxobutanamide |

-continued

| Cpd ID | Structure | IUPAC Name |
|---|---|---|
| 34 | 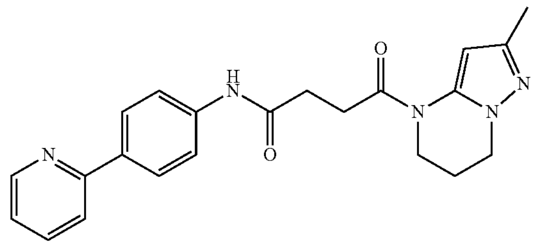 [SMILES: Cc1cc2n(n1)CCCN2C(=O)CCC(=O)Nc1ccc(-c2ccccn2)cc1] | 4-(2-methyl-6,7-dihydropyrazolo[1,5-a]pyrimidin-4(5H)-yl)-4-oxo-N-(4-(pyridin-2-yl)phenyl)butanamide |
| 35 | 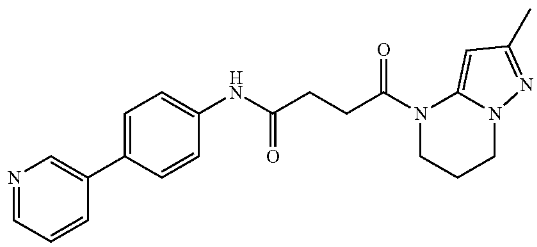 | 4-(2-methyl-6,7-dihydropyrazolo[1,5-a]pyrimidin-4(5H)-yl)-4-oxo-N-(4-(pyridin-3-yl)phenyl)butanamide |
| 36 | 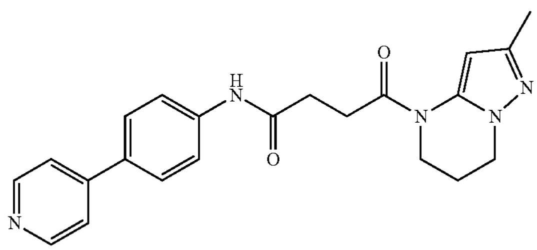 [SMILES: Cc1cc2n(n1)CCCN2C(=O)CCC(=O)Nc1ccc(-c2ccncc2)cc1] | 4-(2-methyl-6,7-dihydropyrazolo[1,5-a]pyrimidin-4(5H)-yl)-4-oxo-N-(4-(pyridin-4-yl)phenyl)butanamide |
| 37 | 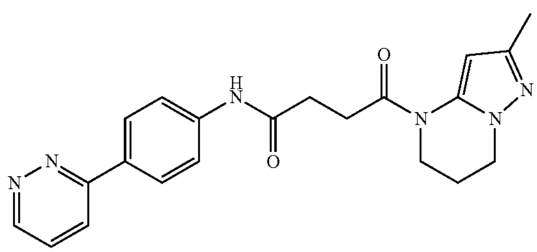 [SMILES: Cc1cc2n(n1)CCCN2C(=O)CCC(=O)Nc1ccc(-c2cccnn2)cc1] | 4-{2-methyl-5H,6H,7H-pyrazolo[1,5-a]pyrimidin-4-yl}-4-oxo-N-[4-(pyridazin-3-yl)phenyl]butanamide |
| 38 | 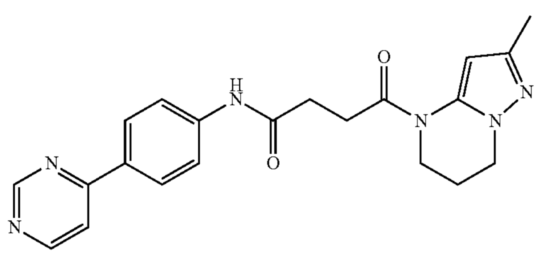 [SMILES: Cc1cc2n(n1)CCCN2C(=O)CCC(=O)Nc1ccc(-c2ccncn2)cc1] | 4-(2-methyl-6,7-dihydropyrazolo[1,5-a]pyrimidin-4(5H)-yl)-4-oxo-N-(4-(pyrimidin-4-yl)phenyl)butanamide |
| 39 | 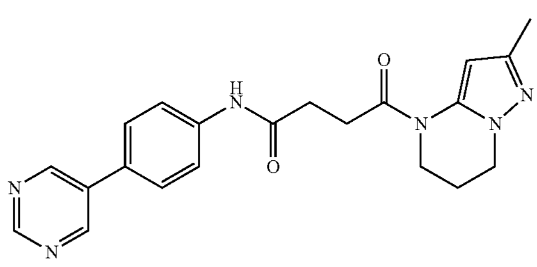 [SMILES: Cc1cc2n(n1)CCCN2C(=O)CCC(=O)Nc1ccc(-c2cncnc2)cc1] | 4-{2-methyl-5H,6H,7H-pyrazolo[1,5-a]pyrimidin-4-yl}-4-oxo-N-[4-(pyrimidin-5-yl)phenyl]butanamide |

| Cpd ID | Structure | IUPAC Name |
|---|---|---|
| 40 | 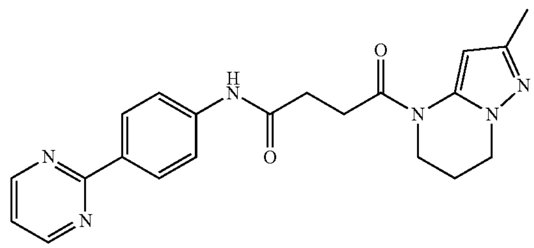 [SMILES: Cc1cc2n(n1)CCCN2C(=O)CCC(=O)Nc1ccc(-c2ncccn2)cc1] | 4-{2-methyl-5H,6H,7H-pyrazolo[1,5-a]pyrimidin-4-yl}-4-oxo-N-[4-(pyrimidin-2-yl)phenyl]butanamide |
| 41 | 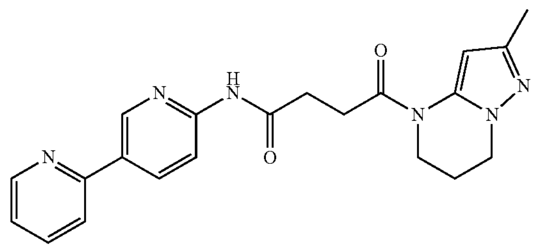 [SMILES: Cc1cc2n(n1)CCCN2C(=O)CCC(=O)Nc1ccc(-c2ccccn2)cn1] | N-([2,3'-bipyridin]-6'-yl)-4-(2-methyl-6,7-dihydropyrazolo[1,5-a]pyrimidin-4(5H)-yl)-4-oxobutanamide |
| 42 | 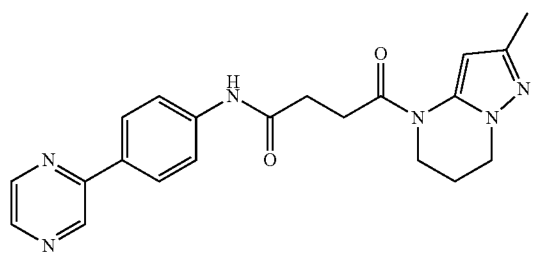 [SMILES: Cc1cc2n(n1)CCCN2C(=O)CCC(=O)Nc1ccc(-c2cnccn2)cc1] | 4-(2-methyl-6,7-dihydropyrazolo[1,5-a]pyrimidin-4(5H)-yl)-4-oxo-N-(4-(pyrazin-2-yl)phenyl)butanamide |
| 43 | 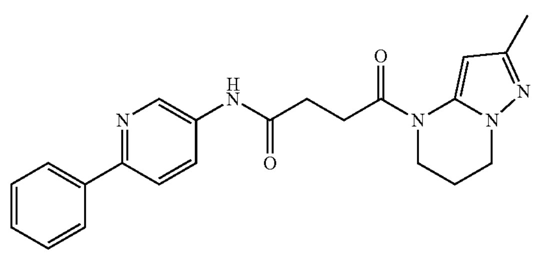 [SMILES: Cc1cc2n(n1)CCCN2C(=O)CCC(=O)Nc1ccc(-c2ccccc2)nc1] | 4-(2-methyl-6,7-dihydropyrazolo[1,5-a]pyrimidin-4(5H)-yl)-4-oxo-N-(6-phenylpyridin-3-yl)butanamide |
| 44 | 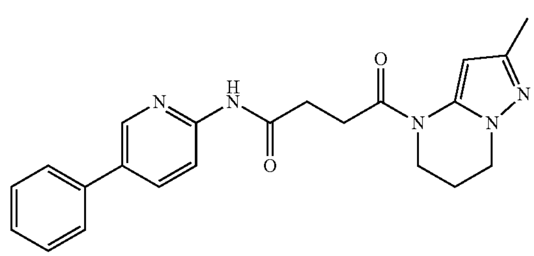 [SMILES: Cc1cc2n(n1)CCCN2C(=O)CCC(=O)Nc1ccc(-c2ccccc2)cn1] | 44Synthesis of 4-(2-methyl-6,7-dihydropyrazolo[1,5-a]pyrimidin-4(5H)-yl)-4-oxo-N-(5-phenylpyridin-2-yl)butanamide |
| 45 | 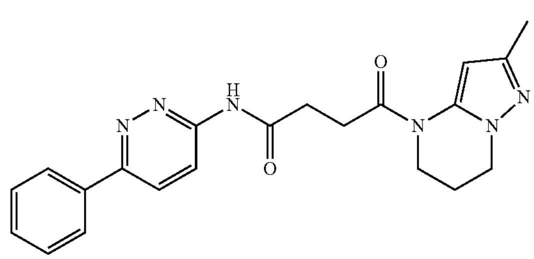 [SMILES: Cc1cc2n(n1)CCCN2C(=O)CCC(=O)Nc1ccc(-c2ccccc2)nn1] | 4-(2-methyl-6,7-dihydropyrazolo[1,5-a]pyrimidin-4(5H)-yl)-4-oxo-N-(6-phenylpyridazin-3-yl)butanamide |

-continued

| Cpd ID | Structure | IUPAC Name |
|---|---|---|
| 46 | 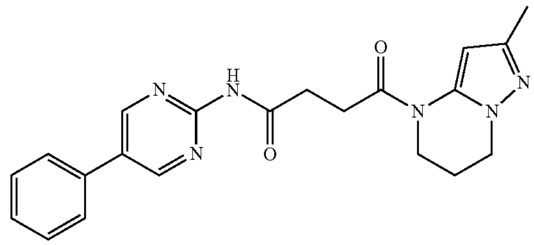 [SMILES: Cc1cc2n(n1)CCCN2C(=O)CCC(=O)Nc1ncc(-c2ccccc2)cn1] | 4-{2-methyl-5H,6H,7H-pyrazolo[1,5-a]pyrimidin-4-yl}-4-oxo-N-(5-phenylpyrimidin-2-yl)butanamide |
| 47 | 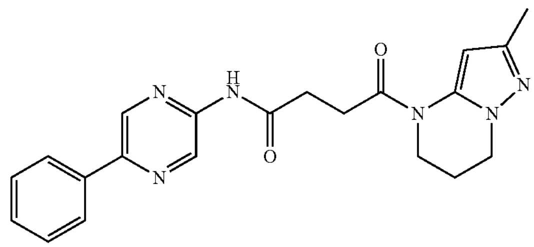 [SMILES: Cc1cc2n(n1)CCCN2C(=O)CCC(=O)Nc1cnc(-c2ccccc2)cn1] | 4-(2-methyl-6,7-dihydropyrazolo[1,5-a]pyrimidin-4(5H)-yl)-4-oxo-N-(5-phenylpyrazin-2-yl)butanamide |
| 48 | 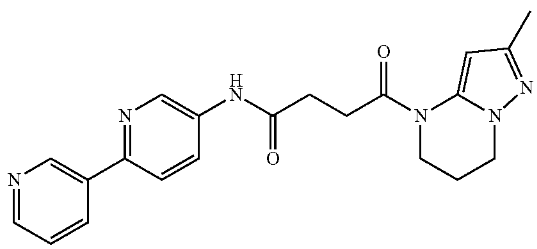 [SMILES: Cc1cc2n(n1)CCCN2C(=O)CCC(=O)Nc1ccc(-c2cccnc2)nc1] | N-([2,3'-bipyridin]-5-yl)-4-(2-methyl-6,7-dihydropyrazolo[1,5-a]pyrimidin-4(5H)-yl)-4-oxobutanamide |
| 49 | 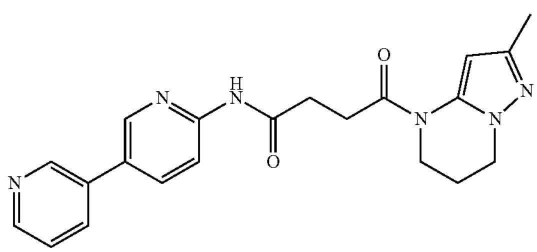 [SMILES: Cc1cc2n(n1)CCCN2C(=O)CCC(=O)Nc1ccc(-c2cccnc2)cn1] | 4-{2-methyl-5H,6H,7H-pyrazolo[1,5-a]pyrimidin-4-yl}-4-oxo-N-[5-(pyridin-3-yl)pyridin-2-yl]butanamide |
| 50 | 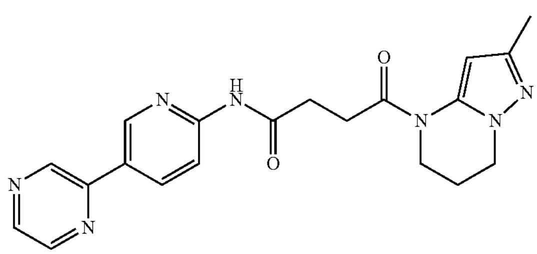 [SMILES: Cc1cc2n(n1)CCCN2C(=O)CCC(=O)Nc1ccc(-c2cnccn2)cn1] | 4-(2-methyl-6,7-dihydropyrazolo[1,5-a]pyrimidin-4(5H)-yl)-4-oxo-N-(5-(pyrazin-2-yl)pyridin-2-yl)butanamide |
| 51 | 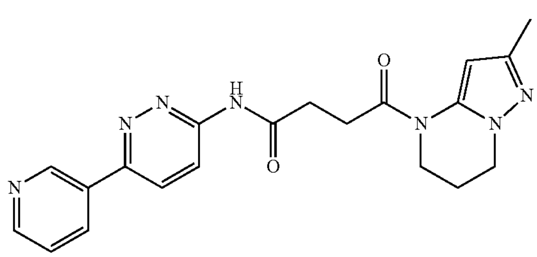 [SMILES: Cc1cc2n(n1)CCCN2C(=O)CCC(=O)Nc1ccc(-c2cccnc2)nn1] | 4-(2-methyl-6,7-dihydropyrazolo[1,5-a]pyrimidin-4(5H)-yl)-4-oxo-N-(6-(pyridin-3-yl)pyridazin-3-yl)butanamide |

-continued

| Cpd ID | Structure | IUPAC Name |
|---|---|---|
| 52 | 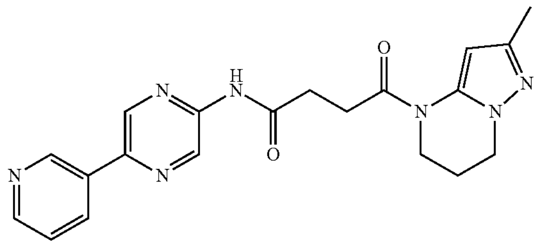 [SMILES: Cc1cc2n(n1)CCCN2C(=O)CCC(=O)Nc1cnc(-c2cccnc2)cn1] | 4-(2-methyl-6,7-dihydropyrazolo[1,5-a]pyrimidin-4(5H)-4-oxo-N-(5-(pyridin-3-yl)pyrazin-2-yl)butanamide |
| 53 | 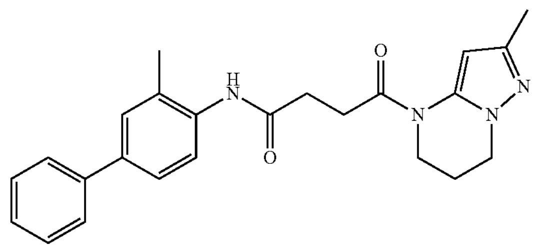 [SMILES: Cc1cc2n(n1)CCCN2C(=O)CCC(=O)Nc1ccc(-c2ccccc2)cc1C] | 4-(2-methyl-6,7-dihydropyrazolo[1,5-a]pyrimidin-4(5H)-yl)-N-(3-methyl-[1,1'-biphenyl]-4-yl)-4-oxobutanamide |
| 54 | 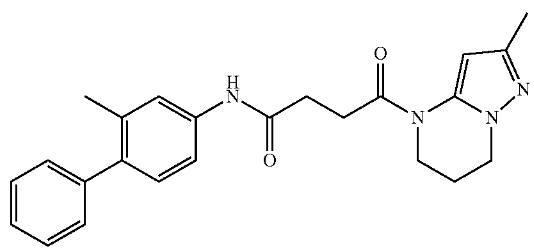 [SMILES: Cc1cc2n(n1)CCCN2C(=O)CCC(=O)Nc1ccc(-c2ccccc2)c(C)c1] | 4-(2-methyl-6,7-dihydropyrazolo[1,5-a]pyrimidin-4(5H)-yl)-N-(2-methyl-[1,1'-biphenyl]-4-yl)-4-oxobutanamide |
| 55 | 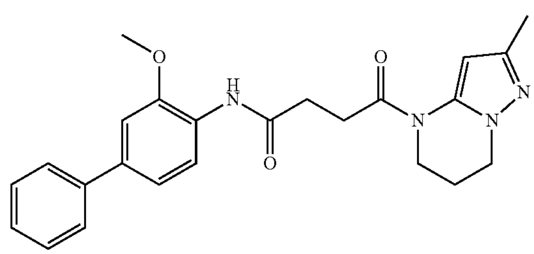 [SMILES: COc1cc(-c2ccccc2)ccc1NC(=O)CCC(=O)N1CCCn2nc(C)cc21] | N-(3-methoxy-[1,1'-biphenyl]-4-yl)-4-(2-methyl-6,7-dihydropyrazolo[1,5-a]pyrimidin-4(5H)-yl)-4-oxobutanamide |
| 56 | 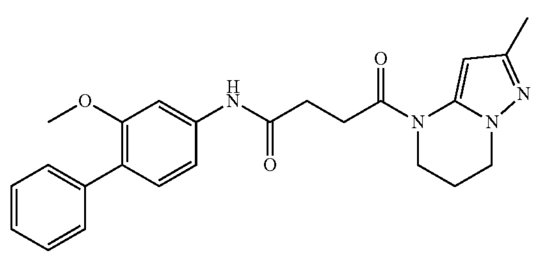 [SMILES: COc1cc(NC(=O)CCC(=O)N2CCCn3nc(C)cc32)ccc1-c1ccccc1] | N-(2-methoxy-[1,1'-biphenyl]-4-yl)-4-(2-methyl-6,7-dihydropyrazolo[1,5-a]pyrimidin-4(5H)-yl)-4-oxobutanamide |
| 57 | 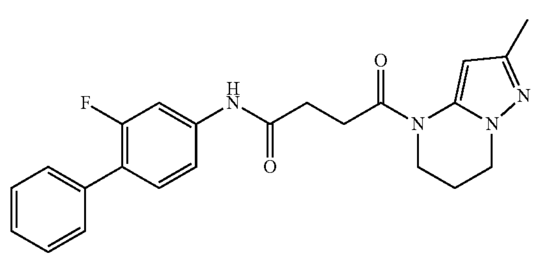 [SMILES: Cc1cc2n(n1)CCCN2C(=O)CCC(=O)Nc1ccc(-c2ccccc2)c(F)c1] | N-(2-fluorobiphenyl-4-yl)-4-(2-methyl-6,7-dihydropyrazolo[1,5-a]pyrimidin-4(5H)-yl)-4-oxobutanamide |

-continued

| Cpd ID | Structure | IUPAC Name |
|---|---|---|
| 58 | 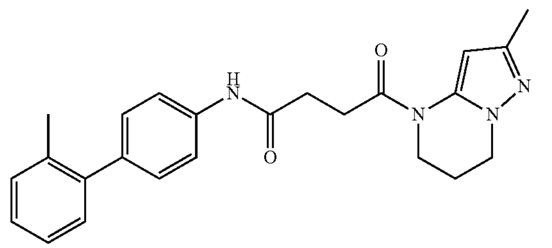 [SMILES: Cc1cc2n(n1)CCCN2C(=O)CCC(=O)Nc1ccc(-c2ccccc2C)cc1] | 4-(2-methyl-6,7-dihydropyrazolo[1,5-a]pyrimidin-4(5H)-yl)-N-(2'-methyl-[1,1'-biphenyl]-4-yl)-4-oxobutanamide |
| 59 | 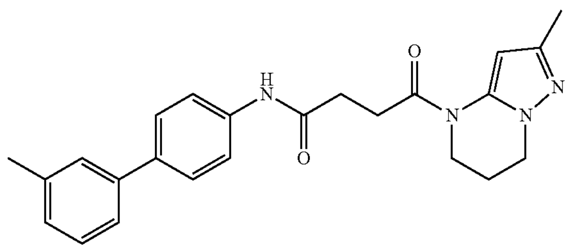 | 4-(2-methyl-6,7-dihydropyrazolo[1,5-a]pyrimidin-4(5H)-yl)-N-(3'-methyl-[1,1'-biphenyl]-4-yl)-4-oxobutanamide |
| 60 | 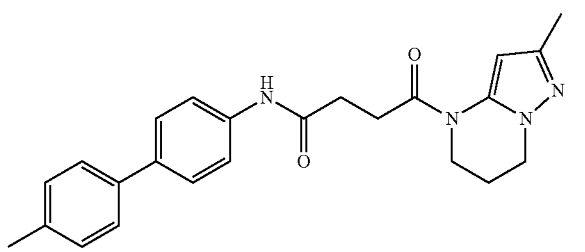 | 4-(2-methyl-6,7-dihydropyrazolo[1,5-a]pyrimidin-4(5H)-yl)-N-(4'-methyl-[1,1'-biphenyl]-4-yl)-4-oxobutanamide |
| 61 | 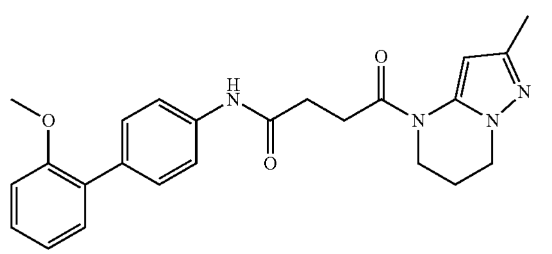 [SMILES: COc1ccccc1-c1ccc(NC(=O)CCC(=O)N2CCCn3nc(C)cc32)cc1] | N-(2'-methoxy-[1,1'-biphenyl]-4-yl)-4-(2-methyl-6,7-dihydropyrazolo[1,5-a]pyrimidin-4(5H)-yl)-4-oxobutanamide |
| 62 | 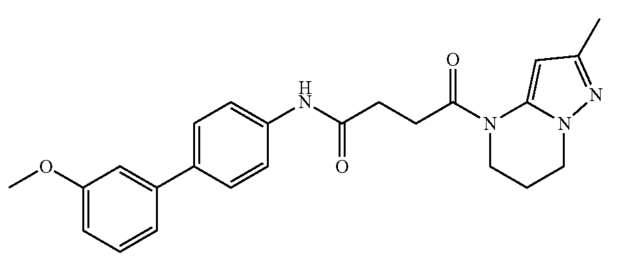 | N-(3'-methoxy-[1,1'-biphenyl]-4-yl)-4-(2-methyl-6,7-dihydropyrazolo[1,5-a]pyrimidin-4(5H)-yl)-4-oxobutanamide |
| 63 | 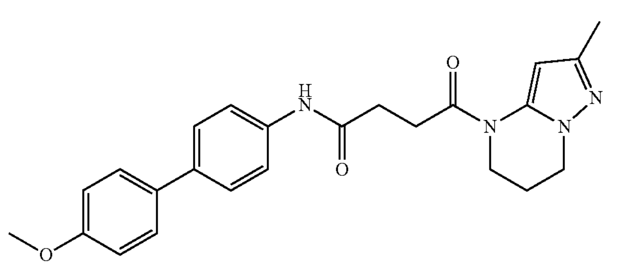 | N-(4'-methoxy-[1,1'-biphenyl]-4-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 64 | 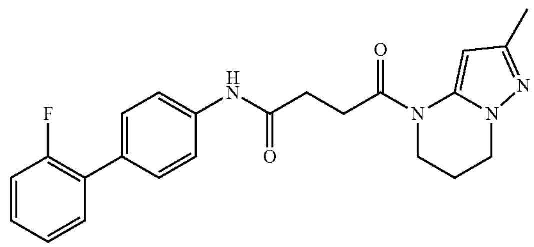 | N-(2'-fluoro-[1,1'-biphenyl]-4-yl)-4-(2-methyl-6,7-dihydropyrazolo[1,5-a]pyrimidin-4(5H)-yl)-4-oxobutanamide |
| 65 | 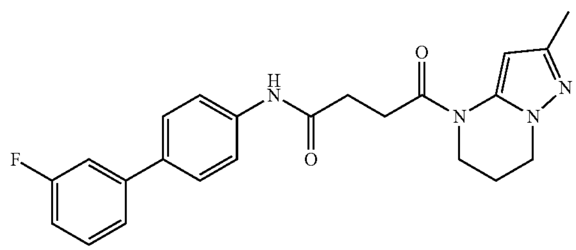 [SMILES: Cc1cc2n(n1)CCCN2C(=O)CCC(=O)Nc1ccc(-c2cccc(F)c2)cc1] | N-(3'-fluoro-[1,1'-biphenyl]-4-yl)-4-(2-methyl-6,7-dihydropyrazolo[1,5-a]pyrimidin-4(5H)-yl)-4-oxobutanamide |
| 66 | 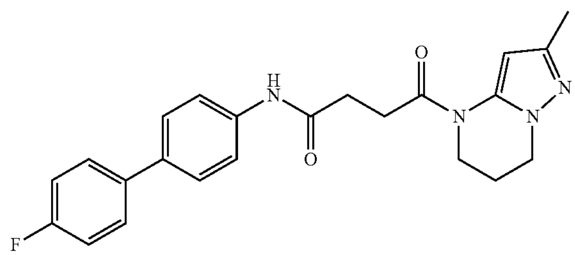 | N-(4'-fluorobiphenyl-4-yl)-4-(2-methyl-6,7-dihydropyrazolo[1,5-a]pyrimidin-4(5H)-yl)-4-oxobutanamide |
| 67 | 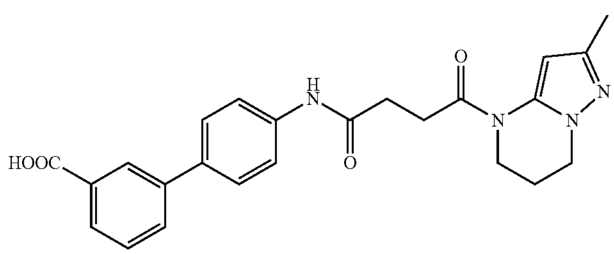 [SMILES: Cc1cc2n(n1)CCCN2C(=O)CCC(=O)Nc1ccc(-c2cccc(C(=O)O)c2)cc1] | 4'-(4-(2-methyl-6,7-dihydropyrazolo[1,5-a]pyrimidin-4(5H)-yl)-4-oxobutanamido)-[1,1'-biphenyl]-3-carboxylic acid |
| 68 | 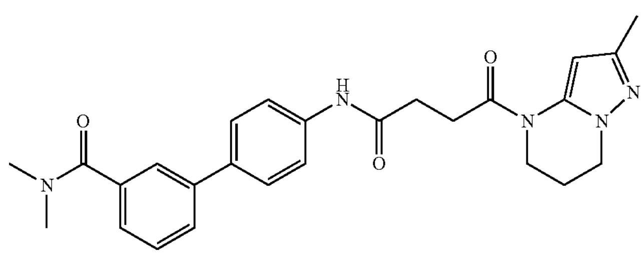 | N,N-dimethyl-4'-(4-(2-methyl-6,7-dihydropyrazolo[1,5-a]pyrimidin-4(5H)-yl)-4-oxobutanamido)-[1,1'-biphenyl]-3-carboxamide |
| 69 | 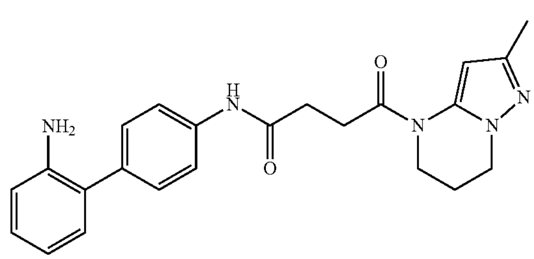 [SMILES: Cc1cc2n(n1)CCCN2C(=O)CCC(=O)Nc1ccc(-c2ccccc2N)cc1] | N-(2'-amino-[1,1'-biphenyl]-4-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 70 | 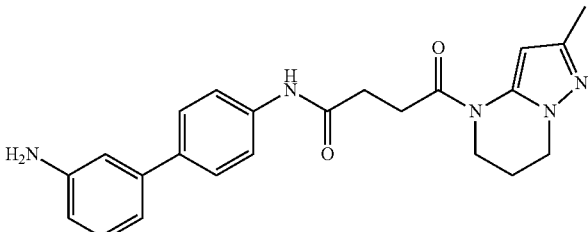 | N-(3'-amino-[1,1'-biphenyl]-4-yl)-4-(2-methyl-6,7-dihydropyrazolo[1,5-a]pyrimidin-4(5H)-yl)-4-oxobutanamide |
| 71 | 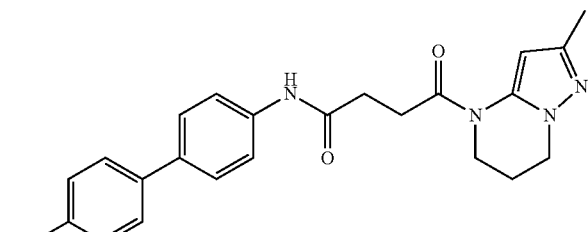 | N-(4'-amino-[1,1'-biphenyl]-4-yl)-4-(2-methyl-6,7-dihydropyrazolo[1,5-a]pyrimidin-4(5H)-yl)-4-oxobutanamide |
| 72 | 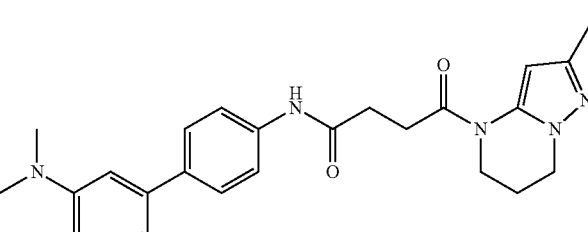 | N-(3'-(dimethylamino)-[1,1'-biphenyl]-4-yl)-4-(2-methyl-6,7-dihydropyrazolo[1,5-a]pyrimidin-4(5H)-yl)-4-oxobutanamide |
| 73 | 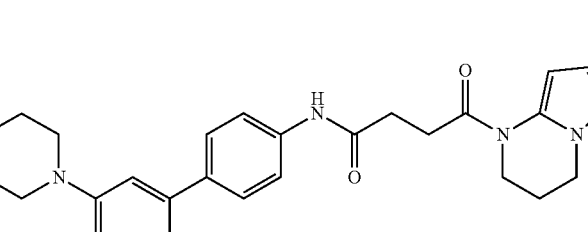 | 4-(2-methyl-6,7-dihydropyrazolo[1,5-a]pyrimidin-4(5H)-yl)-N-(3'-morpholinobiphenyl-4-yl)-4-oxobutanamide |
| 74 | 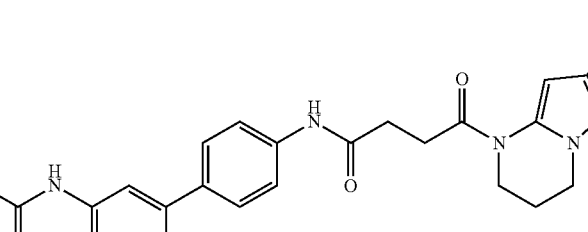 | N-(3'-acetamido-[1,1'-biphenyl]-4-yl)-4-(2-methyl-6,7-dihydropyrazolo[1,5-a]pyrimidin-4(5H)-yl)-4-oxobutanamide |
| 75 | 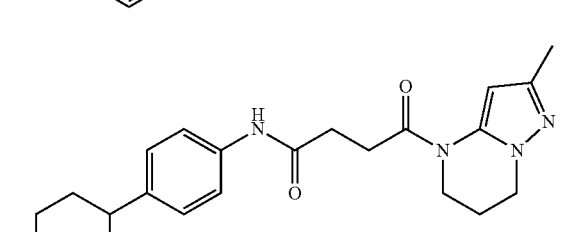 | N-(4-cyclohexylphenyl)-4-(2-methyl-6,7-dihydropyrazolo[1,5-a]pyrimidin-4(5H)-yl)-4-oxobutanamide |

-continued

| Cpd ID | Structure | IUPAC Name |
|---|---|---|
| 76 | 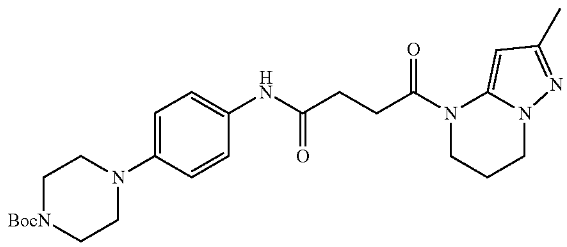 [SMILES: Cc1cc2n(n1)CCCN2C(=O)CCC(=O)Nc1ccc(N2CCN(C(=O)OC(C)(C)C)CC2)cc1] | tert-butyl 4-(4-(4-(2-methyl-6,7-dihydropyrazolo[1,5-a]pyrimidin-4(5H)-yl)-4-oxobutanamido)phenyl)piperazine-1-carboxylate |
| 77 | 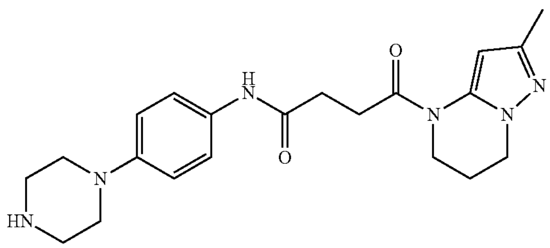 [SMILES: Cc1cc2n(n1)CCCN2C(=O)CCC(=O)Nc1ccc(N2CCNCC2)cc1] | 4-(2-methyl-6,7-dihydropyrazolo[1,5-a]pyrimidin-4(5H)-yl)-4-oxo-N-(4-(piperazin-1-yl)phenyl)butanamide |
| 78 | 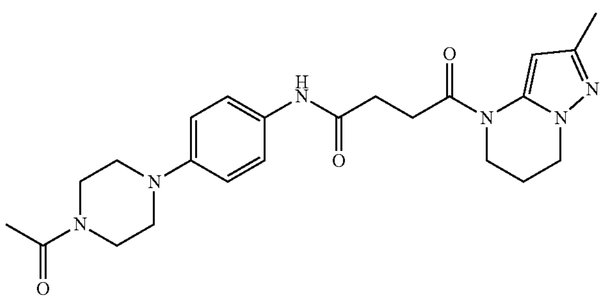 [SMILES: CC(=O)N1CCN(c2ccc(NC(=O)CCC(=O)N3CCCn4nc(C)cc43)cc2)CC1] | N-(4-(4-acetylpiperazin-1-yl)phenyl)-4-(2-methyl-6,7-dihydropyrazolo[1,5-a]pyrimidin-4(5H)-yl)-4-oxobutanamide |
| 79 | 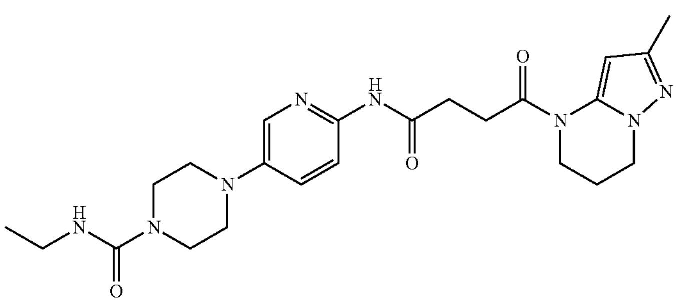 [SMILES: CCNC(=O)N1CCN(c2ccc(NC(=O)CCC(=O)N3CCCn4nc(C)cc43)nc2)CC1] | Synthesis of N-ethyl-4-(6-(4-(2-methyl-6,7-dihydropyrazolo[1,5-a]pyrimidin-4(5H)-yl)-4-oxobutanamido)pyridin-3-yl)piperazine-1-carboxamide |
| 80 | 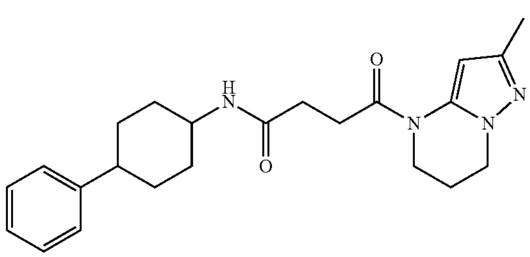 [SMILES: Cc1cc2n(n1)CCCN2C(=O)CCC(=O)NC1CCC(c2ccccc2)CC1] | 4-(2-methyl-6,7-dihydropyrazolo[1,5-a]pyrimidin-4(5H)-yl)-4-oxo-N-(4-phenylcyclohexyl)butanamide |

-continued

| Cpd ID | Structure | IUPAC Name |
|---|---|---|
| 81 | 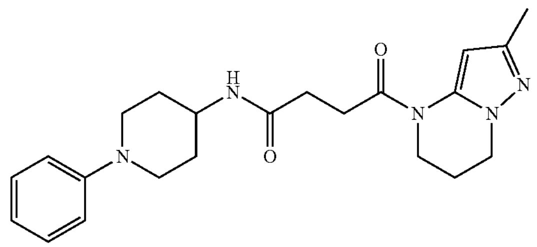 [SMILES: Cc1cc2n(n1)CCCN2C(=O)CCC(=O)NC1CCN(c2ccccc2)CC1] | 4-(2-methyl-6,7-dihydropyrazolo[1,5-a]pyrimidin-4(5H)-yl)-4-oxo-N-(1-phenylpiperidin-4-yl)butanamide |
| 82 | 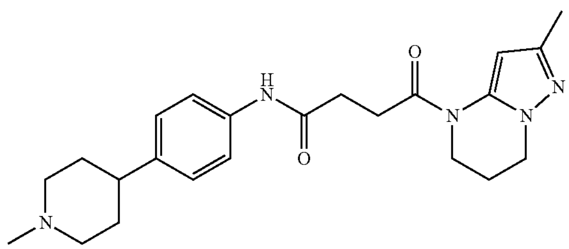 | 4-(2-methyl-6,7-dihydropyrazolo[1,5-a]pyrimidin-4(5H)-yl)-N-(4-(1-methylpiperidin-4-yl)phenyl)-4-oxobutanamide |
| 83 | 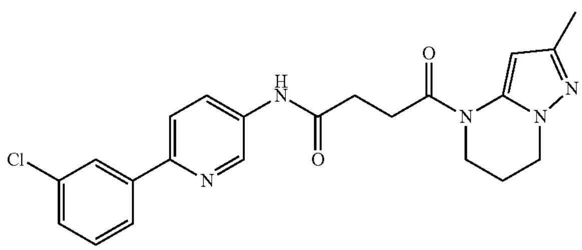 [SMILES: Cc1cc2n(n1)CCCN2C(=O)CCC(=O)Nc1ccc(-c2cccc(Cl)c2)nc1] | N-(6-(3-chlorophenyl)pyridin-3-yl)-4-(2-methyl-6,7-dihydropyrazolo[1,5-a]pyrimidin-4(5H)-yl)-4-oxobutanamide |
| 84 | 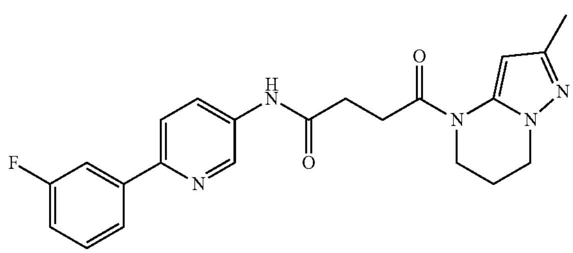 [SMILES: Cc1cc2n(n1)CCCN2C(=O)CCC(=O)Nc1ccc(-c2cccc(F)c2)nc1] | N-(6-(3-fluorophenyl)pyridin-3-yl)-4-(2-methyl-6,7-dihydropyrazolo[1,5-a]pyrimidin-4(5H)-yl)-4-oxobutanamide |
| 85 | 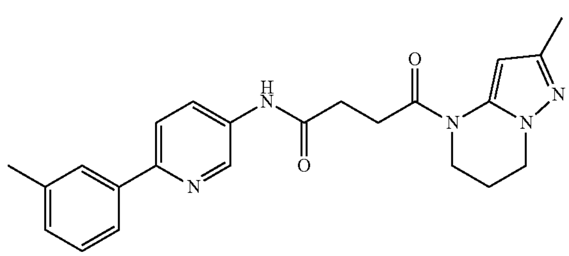 | 4-(2-methyl-6,7-dihydropyrazolo[1,5-a]pyrimidin-4(5H)-yl)-4-oxo-N-(6-(m-tolyl)pyridin-3-yl)butanamide |
| 86 | 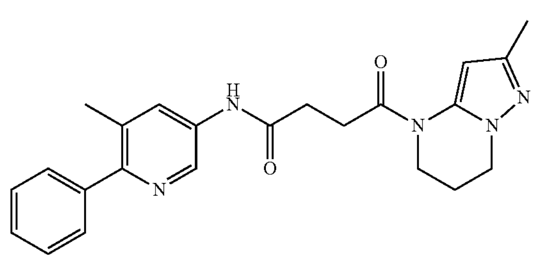 [SMILES: Cc1cc2n(n1)CCCN2C(=O)CCC(=O)Nc1cnc(-c2ccccc2)c(C)c1] | 4-(2-methyl-6,7-dihydropyrazolo[1,5-a]pyrimidin-4(5H)-yl)-N-(5-methyl-6-phenylpyridin-3-yl)-4-oxobutanamide |

-continued

| Cpd ID | Structure | IUPAC Name |
|---|---|---|
| 87 | 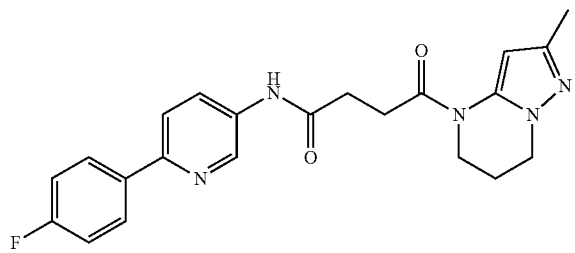 [SMILES: Cc1cc2n(n1)CCCN2C(=O)CCC(=O)Nc1ccc(-c2ccc(F)cc2)nc1] | N-(6-(4-fluorophenyl)pyridin-3-yl)-4-(2-methyl-6,7-dihydropyrazolo[1,5-a]pyrimidin-4(5H)-yl)-4-oxobutanamide |
| 88 | 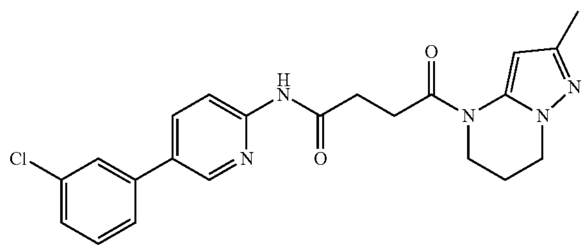 [SMILES: Cc1cc2n(n1)CCCN2C(=O)CCC(=O)Nc1ccc(-c2cccc(Cl)c2)cn1] | N-(6-(3-fluorophenyl)pyridazin-3-yl)-4-(2-methyl-6,7-dihydropyrazolo[1,5-a]pyrimidin-4(5H)-yl)-4-oxobutanamide |
| 89 | 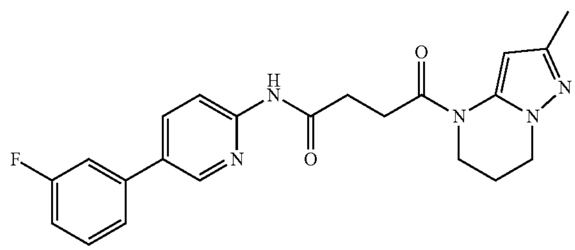 [SMILES: Cc1cc2n(n1)CCCN2C(=O)CCC(=O)Nc1ccc(-c2cccc(F)c2)cn1] | N-(5-(3-fluorophenyl)pyridin-2-yl)-4-(2-methyl-6,7-dihydropyrazolo[1,5-a]pyrimidin-4(5H)-yl)-4-oxobutanamide |
| 90 | 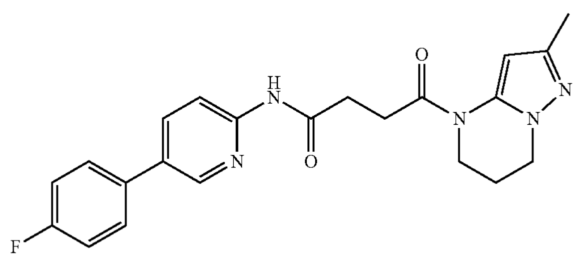 [SMILES: Cc1cc2n(n1)CCCN2C(=O)CCC(=O)Nc1ccc(-c2ccc(F)cc2)cn1] | N-(5-(4-fluorophenyl)pyridin-2-yl)-4-(2-methyl-6,7-dihydropyrazolo[1,5-a]pyrimidin-4(5H)-yl)-4-oxobutanamide |
| 91 | 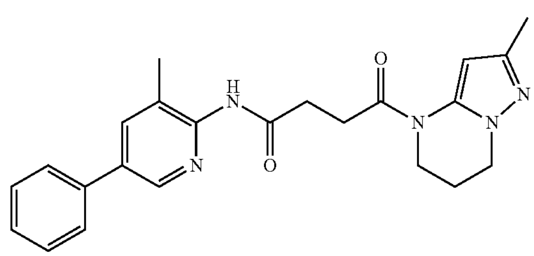 | N-(3-methyl-5-phenylpyridin-2-yl)-4-(2-methyl-6,7-dihydropyrazolo[1,5-a]pyrimidin-4(5H)-yl)-4-oxobutana |
| 92 | 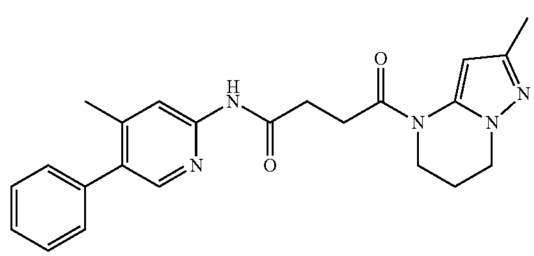 | N-(4-methyl-5-phenylpyridin-2-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 93 | 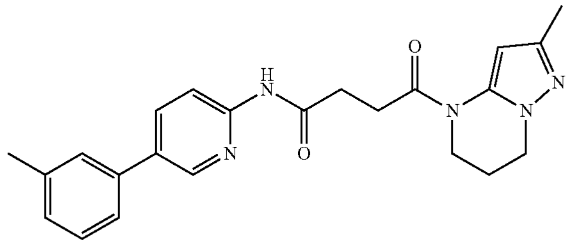 | 4-(2-methyl-6,7-dihydropyrazolo[1,5-a]pyrimidin-4(5H)-yl)-4-oxo-N-(5-(m-tolyl)pyridin-2-yl)butanamide |
| 94 | 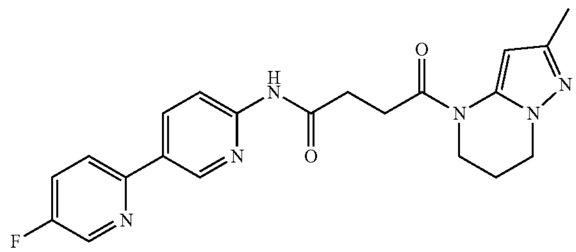 [SMILES: Cc1cc2n(n1)CCCN2C(=O)CCC(=O)Nc1ccc(-c2ccc(F)cn2)cn1] | N-(5-fluoro-2,3'-bipyridin-6'-yl)-4-(2-methyl-6,7-dihydropyrazolo[1,5-a]pyrimidin-4(5H)-yl)-4-oxobutanamide |
| 95 | 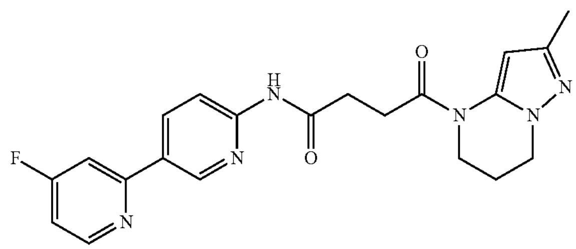 [SMILES: Cc1cc2n(n1)CCCN2C(=O)CCC(=O)Nc1ccc(-c2cc(F)ccn2)cn1] | N-(4-fluoro-2,3'-bipyridin-6'-yl)-4-(2-methyl-6,7-dihydropyrazolo[1,5-a]pyrimidin-4(5H)-yl)-4-oxobutanamide |
| 96 | 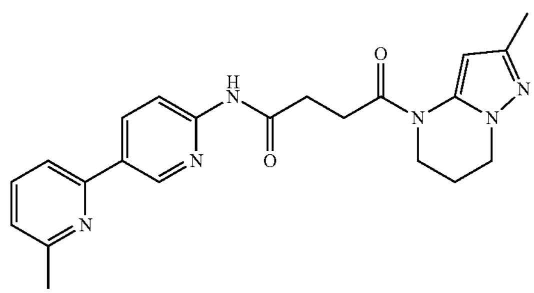 [SMILES: Cc1cccc(-c2ccc(NC(=O)CCC(=O)N3CCCn4nc(C)cc43)nc2)n1] | 4-(2-methyl-6,7-dihydropyrazolo[1,5-a]pyrimidin-4(5H)-yl)-N-(6-methyl-[2,3'-bipyridin]-6'-yl)-4-oxobutanamide |
| 97 | 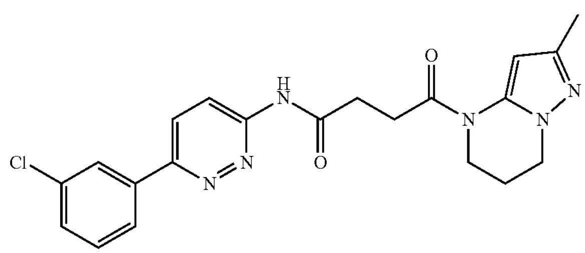 [SMILES: Cc1cc2n(n1)CCCN2C(=O)CCC(=O)Nc1ccc(-c2cccc(Cl)c2)nn1] | N-(6-(3-chlorophenyl)pyridazin-3-yl)-4-(2-methyl-6,7-dihydropyrazolo[1,5-a]pyrimidin-4(5H)-yl)-4-oxobutanamide |
| 98 | 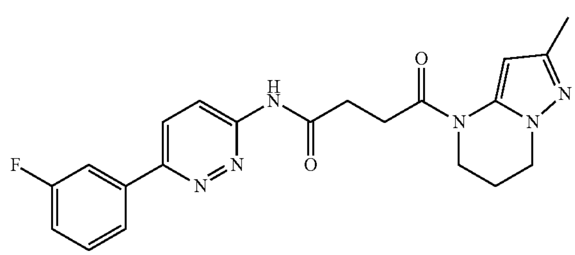 [SMILES: Cc1cc2n(n1)CCCN2C(=O)CCC(=O)Nc1ccc(-c2cccc(F)c2)nn1] | N-(6-(3-fluorophenyl)pyridazin-3-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 99 | 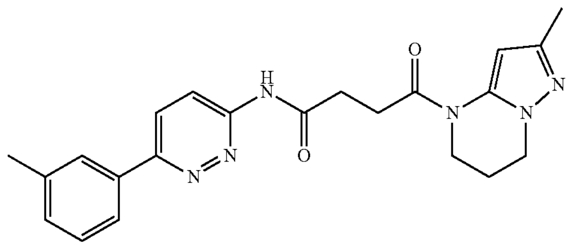 | 4-(2-methyl-6,7-dihydropyrazolo[1,5-a]pyrimidin-4(5H)-yl)-4-oxo-N-(6-(m-tolyl)pyridazin-3-yl)butanamide |
| 100 | 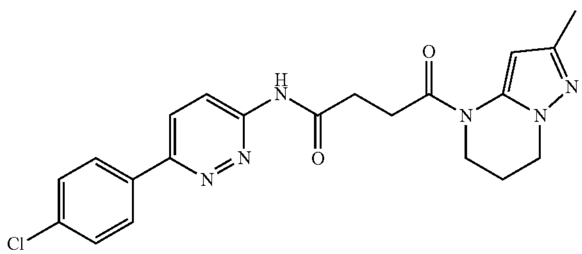 [SMILES: Cc1cc2n(n1)CCCN2C(=O)CCC(=O)Nc1ccc(-c2ccc(Cl)cc2)nn1] | N-[6-(4-chlorophenyl)pyridazin-3-yl]-4-{2-methyl-5H,6H,7H-pyrazolo[1,5-a]pyrimidin-4-yl}-4-oxobutanamide |
| 101 | 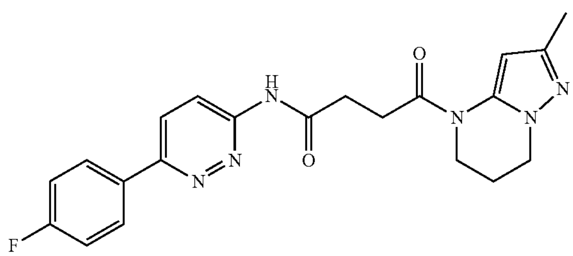 | N-(6-(4-fluorophenyl)pyridazin-3-yl)-4-(2-methyl-6,7-dihydropyrazolo[1,5-a]pyrimidin-4(5H)-yl)-4-oxobutanamide |
| 102 | 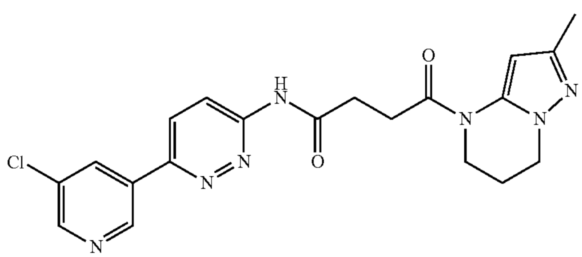 [SMILES: Cc1cc2n(n1)CCCN2C(=O)CCC(=O)Nc1ccc(-c2cncc(Cl)c2)nn1] | N-(6-(5-chloropyridin-3-yl)pyridazin-3-yl)-4-(2-methyl-6,7-dihydropyrazolo[1,5-a]pyrimidin-4(5H)-yl)-4-oxobutanamide |
| 103 | 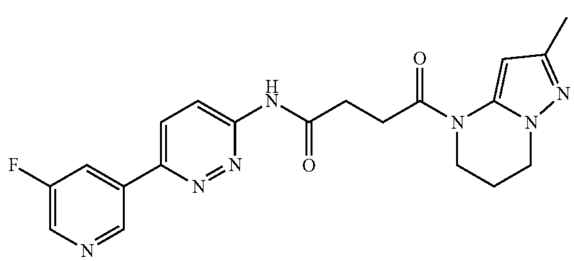 [SMILES: Cc1cc2n(n1)CCCN2C(=O)CCC(=O)Nc1ccc(-c2cncc(F)c2)nn1] | N-(6-(5-fluoropyridin-3-yl)pyridazin-3-yl)-4-(2-methyl-6,7-dihydropyrazolo[1,5-a]pyrimidin-4(5H)-yl)-4-oxobutanamide |
| 104 | 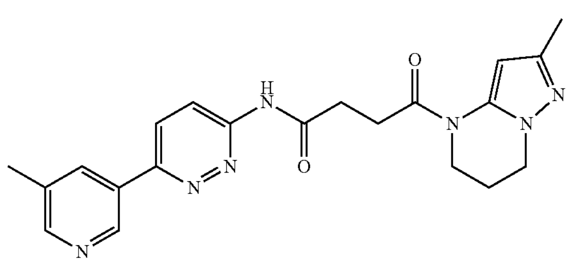 | 4-(2-methyl-6,7-dihydropyrazolo[1,5-a]pyrimidin-4(5H)-yl)-N-(6-(5-methylpyridin-3-yl)pyridazin-3-yl)-4-oxobutanamide |

| Cpd ID | Structure | IUPAC Name |
|---|---|---|
| 105 | 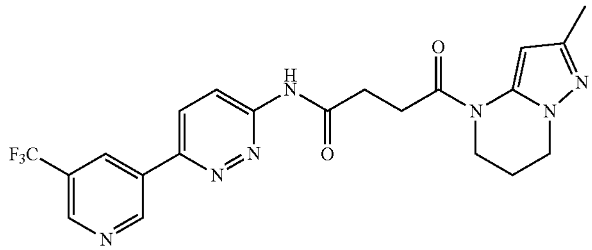 [SMILES: Cc1cc2n(n1)CCCN2C(=O)CCC(=O)Nc1ccc(-c2cncc(C(F)(F)F)c2)nn1] | 4-(2-methyl-6,7-dihydropyrazolo[1,5-a]pyrimidin-4(5H)-yl)-4-oxo-N-(6-(5-(trifluoromethyl)pyridin-3-yl)pyridazin-3-yl)butanamide |
| 106 | 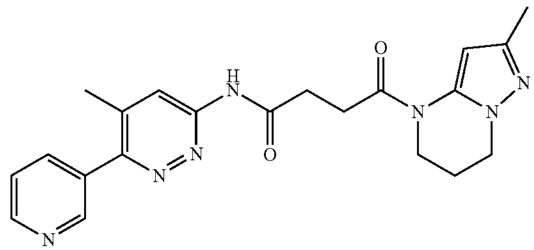 [SMILES: Cc1cc2n(n1)CCCN2C(=O)CCC(=O)Nc1cc(C)c(-c2cccnc2)nn1] | 4-(2-methyl-6,7-dihydropyrazolo[1,5-a]pyrimidin-4(5H)-yl)-N-(5-methyl-6-(pyridin-3-yl)pyridazin-3-yl)-4-oxobutanamide |
| 107 | 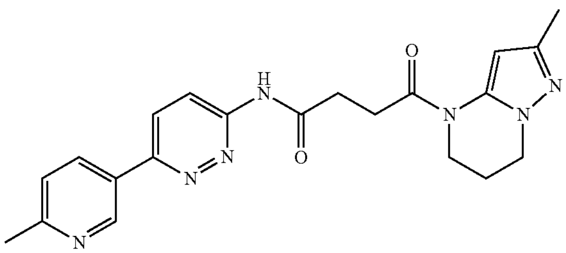 | 4-(2-methyl-6,7-dihydropyrazolo[1,5-a]pyrimidin-4(5H)-yl)-N-(6-(6-methylpyridin-3-yl)pyridazin-3-yl)-4-oxobutanamide |
| 108 | 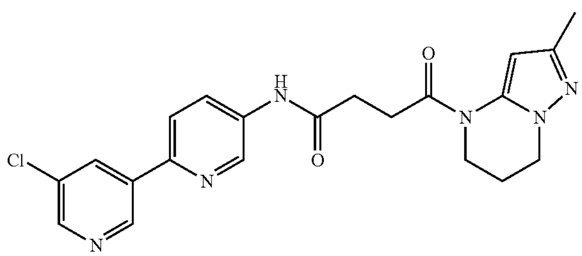 [SMILES: Cc1cc2n(n1)CCCN2C(=O)CCC(=O)Nc1ccc(-c2cncc(Cl)c2)nc1] | N-(5'-chloro-[2,3'-bipyridin]-5-yl)-4-(2-methyl-6,7-dihydropyrazolo[1,5-a]pyrimidin-4(5H)-yl)-4-oxobutanamide |
| 109 | 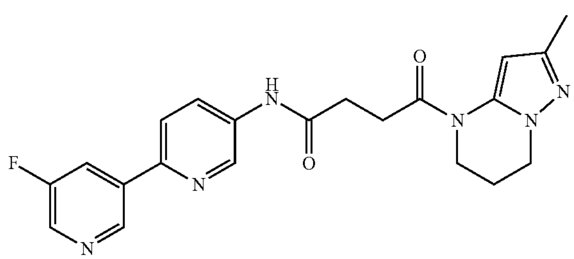 [SMILES: Cc1cc2n(n1)CCCN2C(=O)CCC(=O)Nc1ccc(-c2cncc(F)c2)nc1] | N-(5'-fluoro-[2,3'-bipyridin]-5-yl)-4-(2-methyl-6,7-dihydropyrazolo[1,5-a]pyrimidin-4(5H)-yl)-4-oxobutanamide |
| 110 | 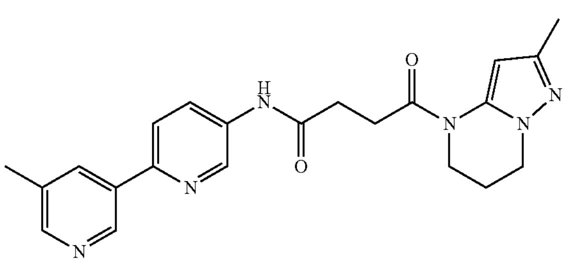 | N-(5'-methyl-2,3'-bipyridin-5-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 111 | 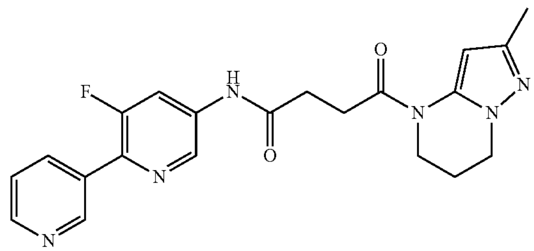 [SMILES: Cc1cc2n(n1)CCCN2C(=O)CCC(=O)Nc1cnc(-c2cccnc2)c(F)c1] | N-(3-fluoro-2,3'-bipyridin-5-yl)-4-(2-methyl-6,7-dihydropyrazolo[1,5-a]pyrimidin-4(5H)-yl)-4-oxobutanamide |
| 112 | 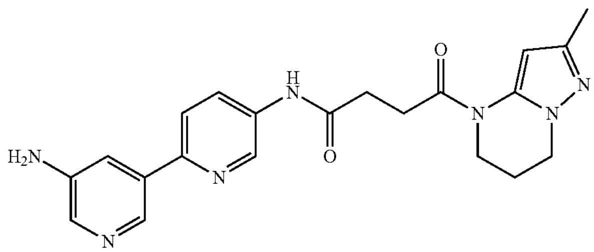 [SMILES: Cc1cc2n(n1)CCCN2C(=O)CCC(=O)Nc1ccc(-c2cncc(N)c2)nc1] | N-(5'-amino-2,3'-bipyridin-5-yl)-4-(2-methyl-6,7-dihydropyrazolo[1,5-a]pyrimidin-4(5H)-yl)-4-oxobutanamide |
| 113 | 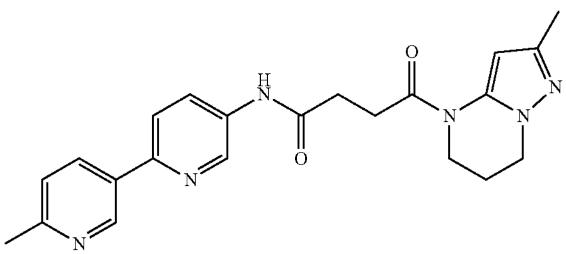 | 4-(2-methyl-6,7-dihydropyrazolo[1,5-a]pyrimidin-4(5H)-yl)-N-(6'-methyl-[2,3'-bipyridin]-5-yl)-4-oxobutanamide |
| 114 | 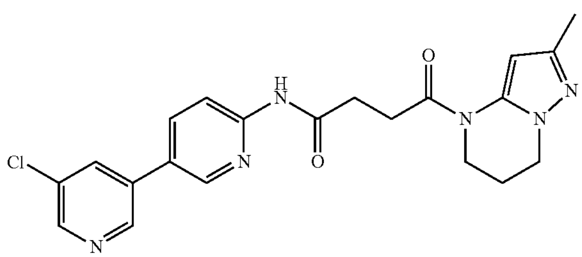 [SMILES: Cc1cc2n(n1)CCCN2C(=O)CCC(=O)Nc1ccc(-c2cncc(Cl)c2)cn1] | N-(5'-chloro-[3,3'-bipyridin]-6-yl)-4-(2-methyl-6,7-dihydropyrazolo[1,5-a]pyrimidin-4(5H)-yl)-4-oxobutanamide |
| 115 | 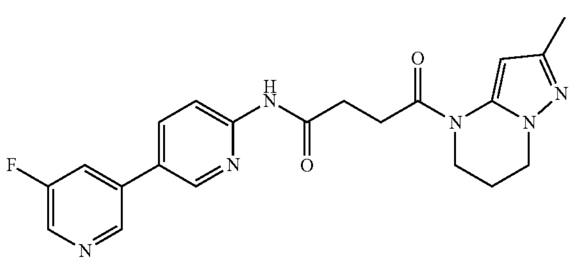 [SMILES: Cc1cc2n(n1)CCCN2C(=O)CCC(=O)Nc1ccc(-c2cncc(F)c2)cn1] | N-(5'-fluoro-[3,3'-bipyridin]-6-yl)-4-(2-methyl-6,7-dihydropyrazolo[1,5-a]pyrimidin-4(5H)-yl)-4-oxobutanamide |
| 116 | 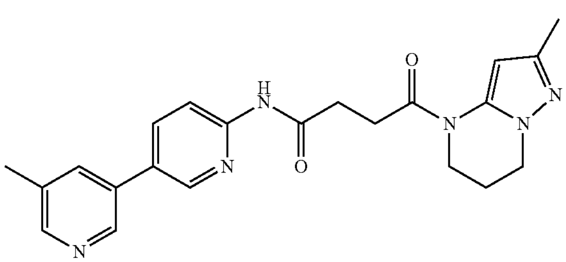 | 4-(2-methyl-6,7-dihydropyrazolo[1,5-a]pyrimidin-4(5H)-yl)-N-(5'-methyl-[3,3'-bipyridin]-6-yl)-4-oxobutanamide |

-continued

| Cpd ID | Structure | IUPAC Name |
|---|---|---|
| 117 | 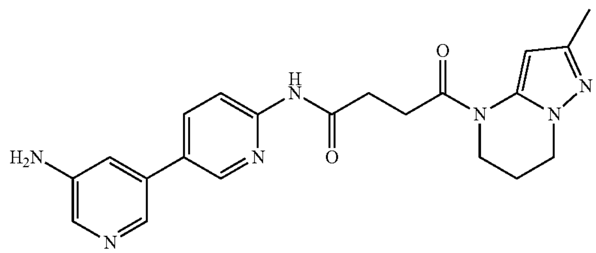 [SMILES: Cc1cc2n(n1)CCCN2C(=O)CCC(=O)Nc1ccc(-c2cncc(N)c2)cn1] | 4-(2-methyl-6,7-dihydropyrazolo[1,5-a]pyrimidin-4(5H)-yl)-4-oxo-N-(4-(piperazin-1-yl)phenyl)butanamide |
| 118 | 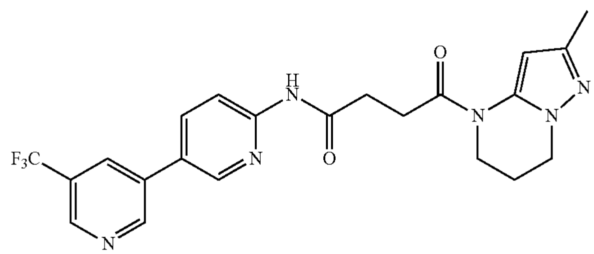 [SMILES: Cc1cc2n(n1)CCCN2C(=O)CCC(=O)Nc1ccc(-c2cncc(C(F)(F)F)c2)cn1] | 4-(2-methyl-6,7-dihydropyrazolo[1,5-a]pyrimidin-4(5H)-yl)-4-oxo-N-(5'-(trifluoromethyl)-[3,3'-bipyridin]-6-yl)butanamide |
| 119 | 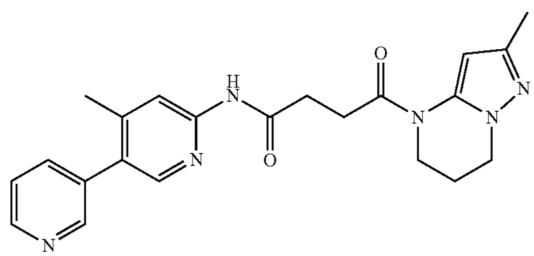 [SMILES: Cc1cc2n(n1)CCCN2C(=O)CCC(=O)Nc1cc(C)c(-c2cccnc2)cn1] | N-(4-methyl-3,3'-bipyridin-6-yl)-4-(2-methyl-6,7-dihydropyrazolo[1,5-a]pyrimidin-4(5H)-yl)-4-oxobutanamide |
| 120 | 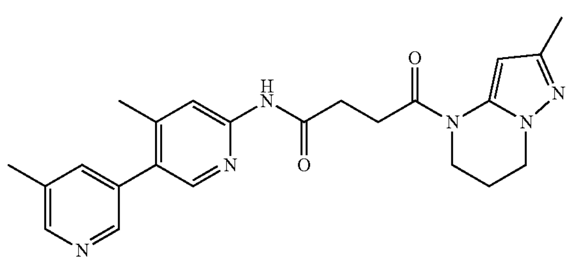 | N-(4,5'-dimethyl-3,3'-bipyridin-6-yl)-4-(2-methyl-6,7-dihydropyrazolo[1,5-a]pyrimidin-4(5H)-yl)-4-oxobutanamide |
| 121 | 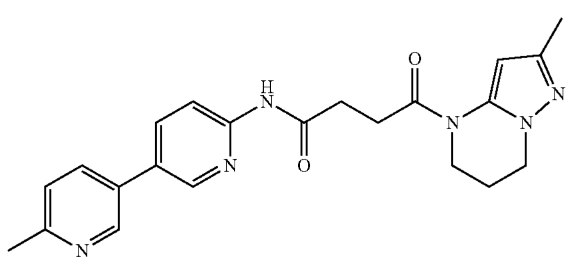 | N-(6'-methyl-3,3'-bipyridin-6-yl)-4-(2-methyl-6,7-dihydropyrazolo[1,5-a]pyrimidin-4(5H)-yl)-4-oxobutanamide |
| 122 | 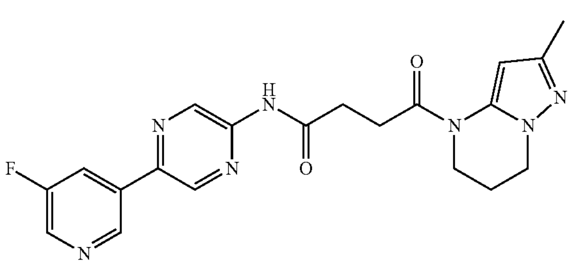 [SMILES: Cc1cc2n(n1)CCCN2C(=O)CCC(=O)Nc1cnc(-c2cncc(F)c2)cn1] | N-(5-(5-fluoropyridin-3-yl)pyrazin-2-yl)-4-(2-methyl-6,7-dihydropyrazolo[1,5-a]pyrimidin-4(5H)-yl)-4-oxobutanamide |

-continued

| Cpd ID | Structure | IUPAC Name |
|---|---|---|
| 123 | 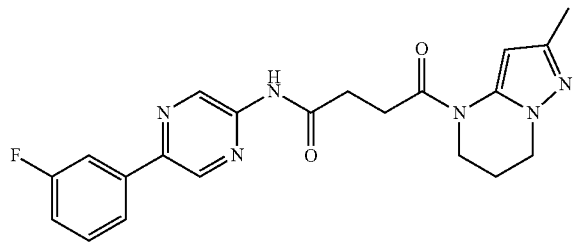 [SMILES: Cc1cc2n(n1)CCCN2C(=O)CCC(=O)Nc1cnc(-c2cccc(F)c2)cn1] | N-(5-(3-fluorophenyl)pyrazin-2-yl)-4-(2-methyl-6,7-dihydropyrazolo[1,5-a]pyrimidin-4(5H)-yl)-4-oxobutanamide |
| 124 | 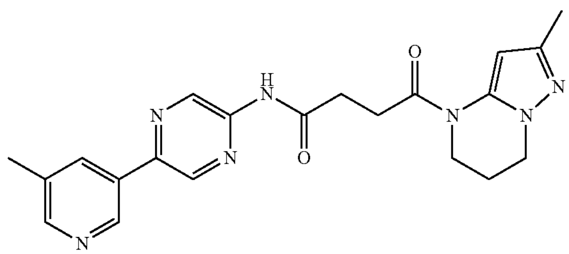 | 4-(2-methyl-6,7-dihydropyrazolo[1,5-a]pyrimidin-4(5H)-yl)-N-(5-(5-methylpyridin-3-yl)pyrazin-2-yl)-4-oxobutanamide |
| 125 | 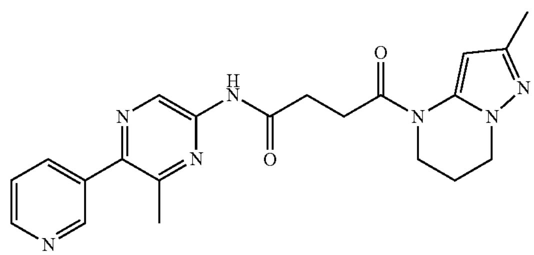 [SMILES: Cc1cc2n(n1)CCCN2C(=O)CCC(=O)Nc1cnc(-c2cccnc2)c(C)n1] | N-(6-methyl-5-(pyridin-3-yl)pyrazin-2-yl)-4-(2-methyl-6,7-dihydropyrazolo[1,5-a]pyrimidin-4(5H)-yl)-4-oxobutanamide |
| 126 | 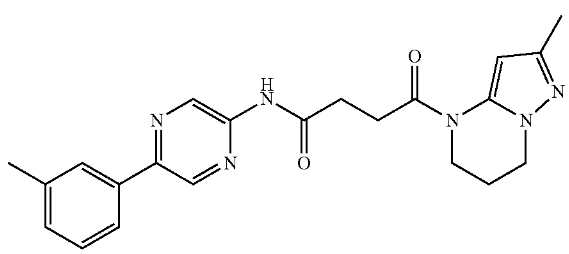 | 4-(2-methyl-6,7-dihydropyrazolo[1,5-a]pyrimidin-4(5H)-yl)-4-oxo-N-(5-m-tolyl)pyrazin-2-yl)butanamide |
| 127 | 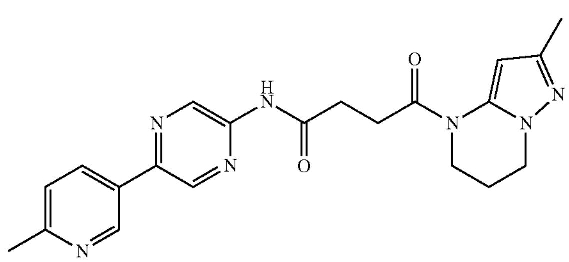 | 4-(2-methyl-6,7-dihydropyrazolo[1,5-a]pyrimidin-4(5H)-yl)-N-(5-(6-methylpyridin-3-yl)pyrazin-2-yl)-4-oxobutanamide |
| 128 | 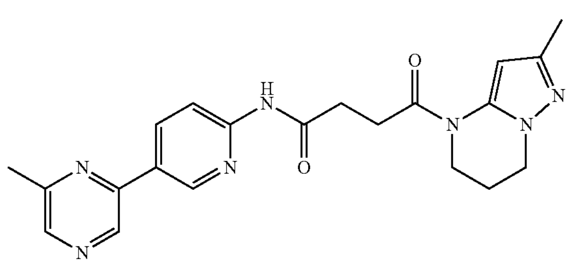 | 4-(2-methyl-6,7-dihydropyrazolo[1,5-a]pyrimidin-4(5H)-yl)-N-(5-(6-methylpyrazin-2-yl)pyridin-2-yl)-4-oxobutanamide |

| Cpd ID | Structure | IUPAC Name |
|---|---|---|
| 129 | 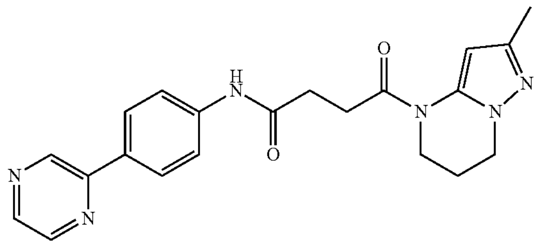 | 4-(2-methyl-6,7-dihydropyrazolo[1,5-a]pyrimidin-4(5H)-yl)-4-oxo-N-(4-(pyrazin-2-yl)phenyl)butanamide |
| 130 | 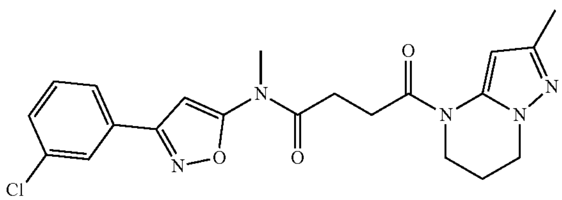 [SMILES: Cc1cc2n(n1)CCCN2C(=O)CCC(=O)N(C)c1cc(-c2cccc(Cl)c2)no1] | N-(3-(3-chlorophenyl)isoxazol-5-yl)-N-methyl-4-(2-methyl-6,7-dihydropyrazolo[1,5-a]pyrimidin-4(5H)-yl)-4-oxobutanamide |
| 131 | 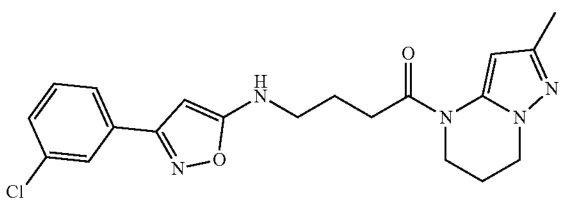 [SMILES: Cc1cc2n(n1)CCCN2C(=O)CCCNc1cc(-c2cccc(Cl)c2)no1] | 3-(3-chlorophenyl)-N-(4-(2-methyl-6,7-dihydropyrazolo[1,5-a]pyrimidin-4(5H)-yl)butyl)isoxazol-5-amine |
| 132 | 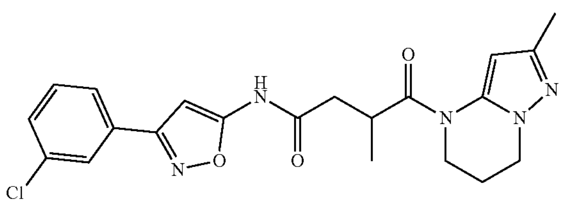 [SMILES: Cc1cc2n(n1)CCCN2C(=O)C(C)CC(=O)Nc1cc(-c2cccc(Cl)c2)no1] | N-(3-(3-chlorophenyl)isoxazol-5-yl)-3-methyl-4-(2-methyl-6,7-dihydropyrazolo[1,5-a]pyrimidin-4(5H)-yl)-4-oxobutanamide |
| 133 | 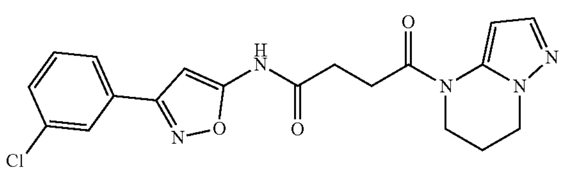 [SMILES: O=C(CCC(=O)N1CCCn2nccc21)Nc1cc(-c2cccc(Cl)c2)no1] | N-(3-(3-chlorophenyl)isoxazol-5-yl)-4-(6,7-dihydropyrazolo[1,5-a]pyrimidin-4(5H)-yl)-4-oxobutanamide |
| 134 | 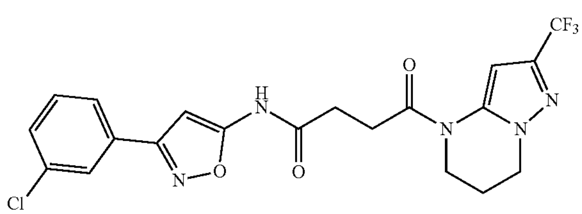 [SMILES: O=C(CCC(=O)N1CCCn2nc(C(F)(F)F)cc21)Nc1cc(-c2cccc(Cl)c2)no1] | N-(3-(3-chlorophenyl)isoxazol-5-yl)-4-oxo-4-(2-(trifluoromethyl)-6,7-dihydropyrazolo[1,5-a]pyrimidin-4(5H)-yl)butanamide |
| 135 | 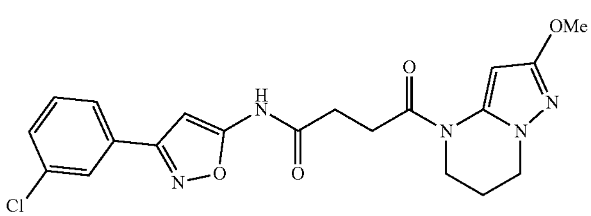 [SMILES: COc1cc2n(n1)CCCN2C(=O)CCC(=O)Nc1cc(-c2cccc(Cl)c2)no1] | N-(3-(3-chlorophenyl)isoxazol-5-yl)-4-(2-methoxy-6,7-dihydropyrazolo[1,5-a]pyrimidin-4(5H)-yl)-4-oxobutanamide |

| Cpd ID | Structure | IUPAC Name |
|---|---|---|
| 136 | 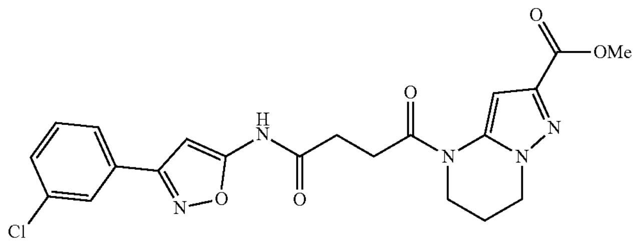 [SMILES: COC(=O)c1cc2n(n1)CCCN2C(=O)CCC(=O)Nc1cc(-c2cccc(Cl)c2)no1] | methyl 4-(4-(3-(3-chlorophenyl)isoxazol-5-ylamino)-4-oxobutanoyl)-4,5,6,7-tetrahydropyrazolo[1,5-a]pyrimidine-2-carboxylate |
| 137 | 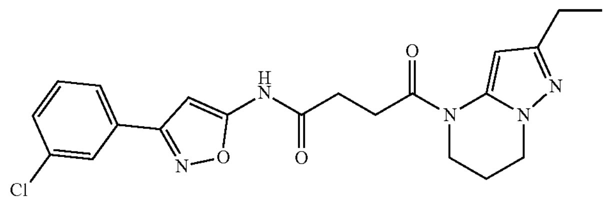 [SMILES: CCc1cc2n(n1)CCCN2C(=O)CCC(=O)Nc1cc(-c2cccc(Cl)c2)no1] | N-(3-(3-chlorophenyl)isoxazol-5-yl)-4-(2-ethyl-6,7-dihydropyrazolo[1,5-a]pyrimidin-4(5H)-yl)-4-oxobutanamide |
| 138 | 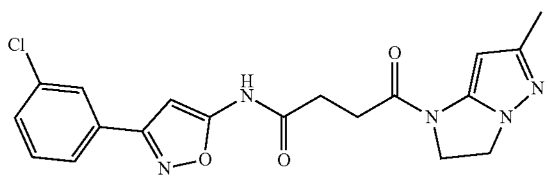 [SMILES: Cc1cc2n(n1)CCN2C(=O)CCC(=O)Nc1cc(-c2cccc(Cl)c2)no1] | N-(3-(3-chlorophenyl)isoxazol-5-yl)-4-(6-methyl-2,3-dihydro-1H-imidazo[1,2-b]pyrazol-1-yl)-4-oxobutanamide |
| 139 | 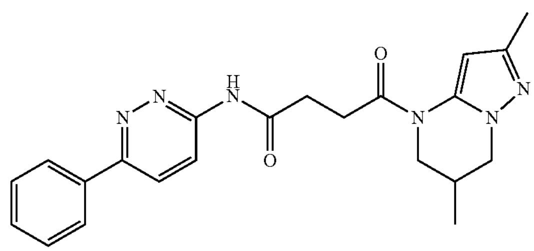 [SMILES: Cc1cc2n(n1)CC(C)CN2C(=O)CCC(=O)Nc1ccc(-c2ccccc2)nn1] | 4-(2,6-dimethyl-6,7-dihydropyrazolo[1,5-a]pyrimidin-4(5H)-yl)-4-oxo-N-(6-phenylpyridazin-3-yl)butanamide |
| 140 | 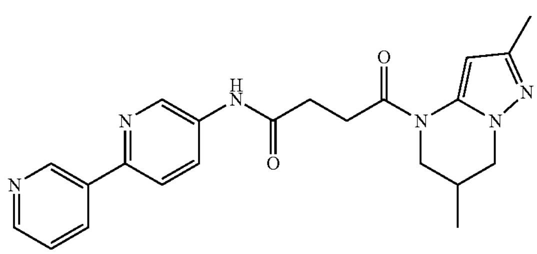 [SMILES: Cc1cc2n(n1)CC(C)CN2C(=O)CCC(=O)Nc1ccc(-c2cccnc2)nc1] | N-(2,3'-bipyridin-5-yl)-4-(2,6-dimethyl-6,7-dihydropyrazolo[1,5-a]pyrimidin-4(5H)-yl)-4-oxobutanamide |
| 141 | 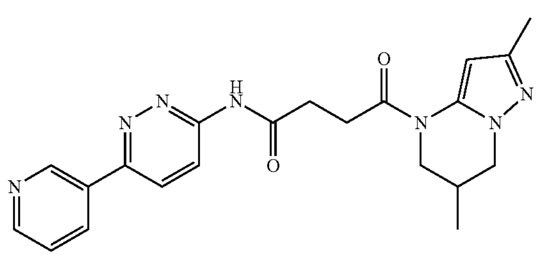 [SMILES: Cc1cc2n(n1)CC(C)CN2C(=O)CCC(=O)Nc1ccc(-c2cccnc2)nn1] | 4-(2,6-dimethyl-6,7-dihydropyrazolo[1,5-a]pyrimidin-4(5H)-yl)-4-oxo-N-(6-(pyridin-3-yl)pyridazin-3-yl)butanamide |

| Cpd ID | Structure | IUPAC Name |
| --- | --- | --- |
| 142 | 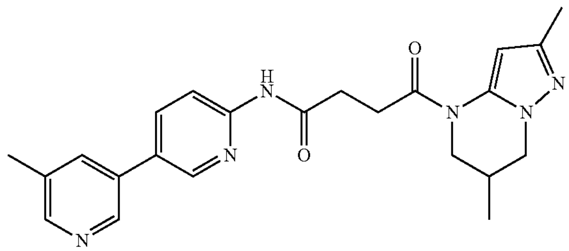 | 4-(2,6-dimethyl-6,7-dihydropyrazolo[1,5-a]pyrimidin-4(5H)-yl)-N-(5'-methyl-[3,3'-bipyridin-6-yl)-4-oxobutanamide |
| 143 | 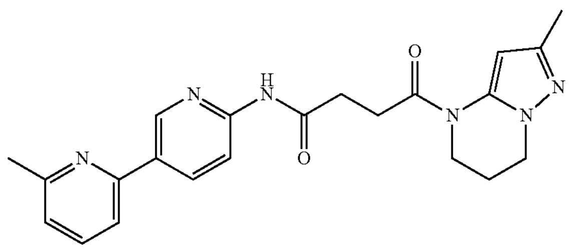 | 4-(2-methyl-6,7-dihydropyrazolo[1,5-a]pyrimidin-4(5H)-yl)-N-(6-methyl-[2,3'-bipyridin]-6'-yl)-4-oxobutanamide |
| 144 | 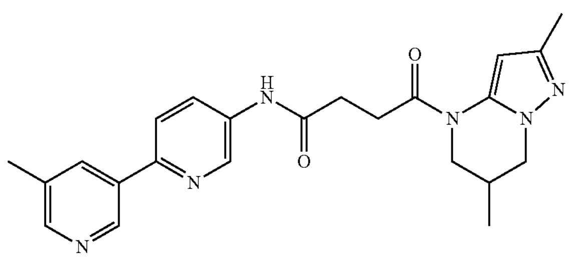 | 4-(2,6-dimethyl-6,7-dihydropyrazolo[1,5-a]pyrimidin-4(5H)-yl)-N-(5'-methyl-[2,3'-bipyridin]-5-yl)-4-oxobutanamide |
| 145 | 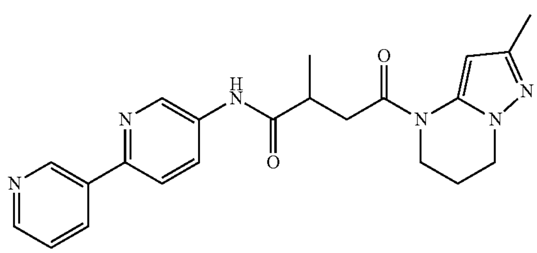 [SMILES: Cc1cc2n(n1)CCCN2C(=O)CC(C)C(=O)Nc1ccc(-c2cccnc2)nc1] | N-([2,3'-bipyridin]-5-yl)-2-methyl-4-(2-methyl-6,7-dihydropyazolo[1,5-a]pyrimidin-4(5H)-yl)-4-oxobutanamide |
| 146 | 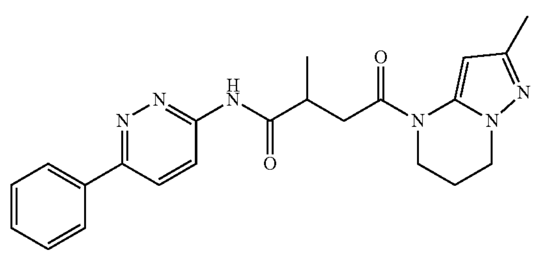 [SMILES: Cc1cc2n(n1)CCCN2C(=O)CC(C)C(=O)Nc1ccc(-c2ccccc2)nn1] | 2-methyl-4-(2-methyl-6,7-dihydropyrazolo[1,5-a]pyrimidin-4(5H)-yl)-4-oxo-N-(6-phenylpyridazin-3-yl)butanamide |
| 147 | 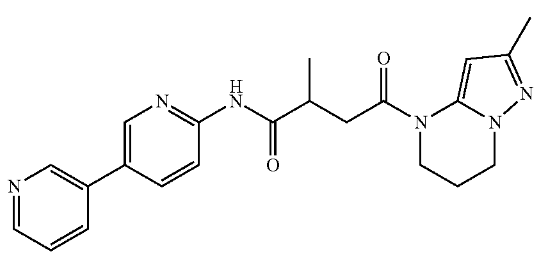 [SMILES: Cc1cc2n(n1)CCCN2C(=O)CC(C)C(=O)Nc1ccc(-c2cccnc2)cn1] | N-([3,3'-bipyridin]-6-yl)-2-methyl-4-(2-methyl-6,7-dihydropyrazolo[1,5-a]pyrimidin-4(5H)-yl)-4-oxobutanamide |

| Cpd ID | Structure | IUPAC Name |
|---|---|---|
| 148 | 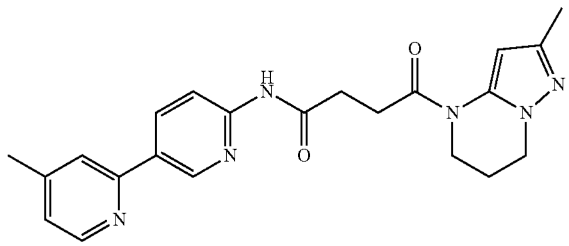 | N-(4-methyl-2,3'-bipyridin-6'-yl)-4-(2-methyl-6,7-dihydropyrazolo[1,5-a]pyrimidin-4(5H)-yl)-4-oxobutanamide |
| 149 | 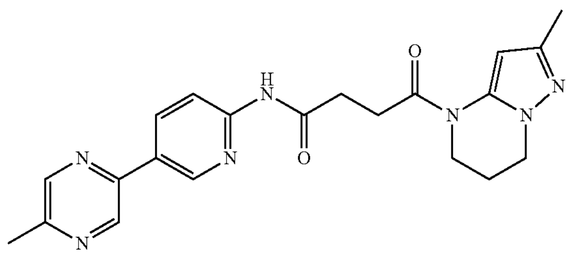 | 4-(2-methyl-6,7-dihydropyrazolo[1,5-a]pyrimidin-4(5H)-yl)-N-(5-(5-methylpyrazin-2-yl)pyridin-2-yl)-4-oxobutanamide |
| 150 | 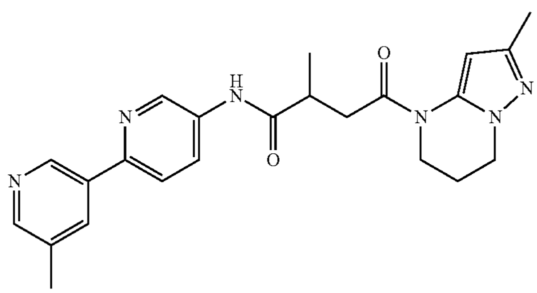 [SMILES: Cc1cncc(-c2ccc(NC(=O)C(C)CC(=O)N3CCCn4nc(C)cc43)cn2)c1] | 2-methyl-4-(2-methyl-6,7-dihydropyrazolo[1,5-a]pyrimidin-4(5H)-yl)-N-(5'-methyl-[2,3'-bipyridin]-5-yl)-4-oxobutanamide |
| 151 | 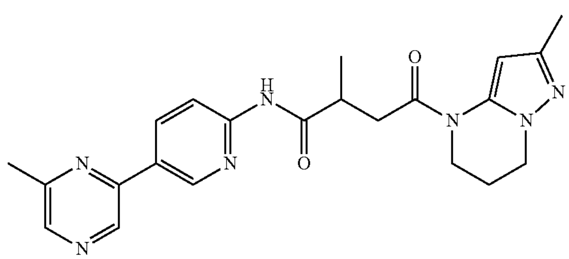 | 2-methyl-4-(2-methyl-6,7-dihydropyrazolo[1,5-a]pyrimidin-4(5H)-yl)-N-(5-(6-methylpyrazin-2-yl)pyridin-2-yl)-4-oxobutanamide |
| 152 | 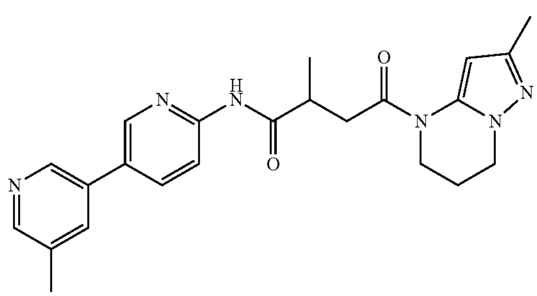 [SMILES: Cc1cncc(-c2ccc(NC(=O)C(C)CC(=O)N3CCCn4nc(C)cc43)nc2)c1] | 2-methyl-4-(2-methyl-6,7-dihydropyrazolo[1,5-a]pyrimidin-4(5H)-yl)-N-(5'-methyl-[3,3'-bipyridin]-6-yl)-4-oxobutanamide |

| Cpd ID | Structure | IUPAC Name |
|---|---|---|
| 153 | 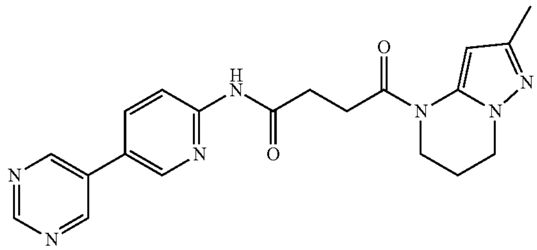 [SMILES: Cc1cc2n(n1)CCCN2C(=O)CCC(=O)Nc1ccc(-c2cncnc2)cn1] | 4-(2-methyl-6,7-dihydropyrazolo[1,5-a]pyrimidin-4(5H)-yl)-4-oxo-N-(5-(pyrimidin-5-yl)pyridin-2-yl)butanamide |
| 154 | 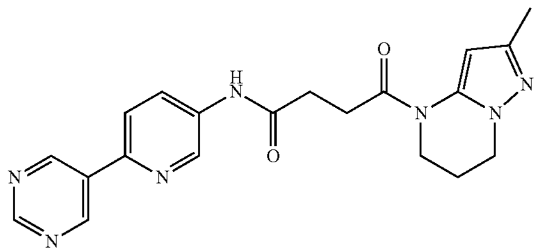 [SMILES: Cc1cc2n(n1)CCCN2C(=O)CCC(=O)Nc1ccc(-c2cncnc2)nc1] | 4-(2-methyl-6,7-dihydropyrazolo[1,5-a]pyrimidin-4(5H)-yl)-4-oxo-N-(6-(pyrimidin-5-yl)pyridin-3-yl)butanamide |
| 155 | 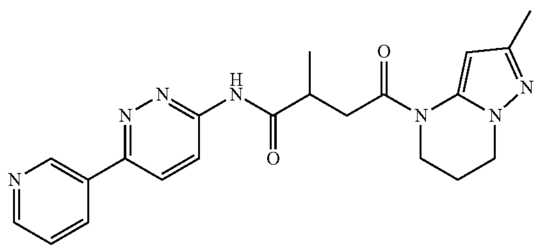 [SMILES: Cc1cc2n(n1)CCCN2C(=O)CC(C)C(=O)Nc1ccc(-c2cccnc2)nn1] | N-(2-fluorobiphenyl-4-yl)-4-(2-methyl-6,7-dihydropyrazolo[1,5-a]pyrimidin-4(5H)-yl)-4-oxobutanamide |
| 156 | 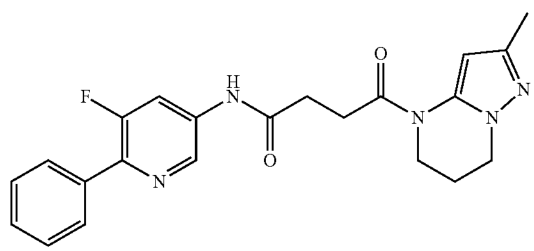 | N-(5-fluoro-6-phenylpyridin-3-yl)-4-(2-methyl-6,7-dihydropyrazolo[1,5-a]pyrimidin-4(5H)-yl)-4-oxobutanamide |
| 157 | 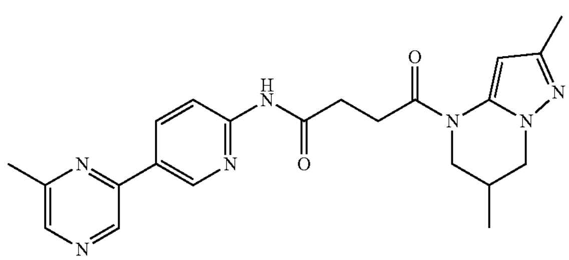 | 4-(2,6-dimethyl-6,7-dihydropyrazolo[1,5-a]pyrimidin-4(5H)-yl)-N-(5-(6-methylpyrazin-2-yl)pyridin-2-yl)-4-oxobutanamide |
| 158 | 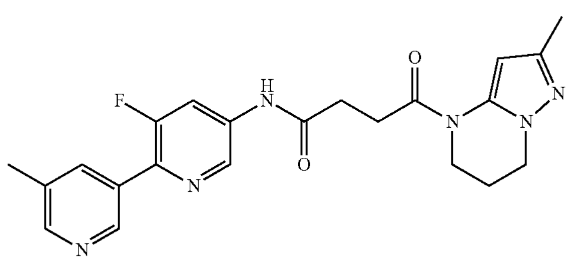 | N-(3-fluoro-5'-methyl-[2,3'-bipyridin]-5-yl)-4-(2-methyl-6,7-dihydropyrazolo[1,5-a]pyrimidin-4(5H)-yl)-4-oxobutanamide |

| Cpd ID | Structure | IUPAC Name |
|---|---|---|
| 159 | 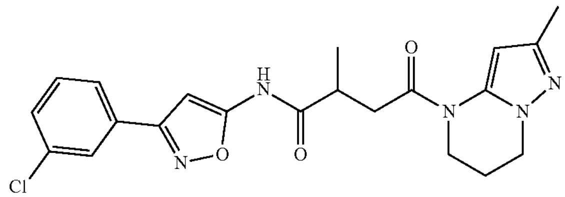 [SMILES: Cc1cc2n(n1)CCCN2C(=O)CC(C)C(=O)Nc1cc(-c2cccc(Cl)c2)no1] | N-(3-(3-chlorophenyl)isoxazol-5-yl)-2-methyl-4-(2-methyl-6,7-dihydropyrazolo[1,5-a]pyrimidin-4(5H)-yl)-4-oxobutanamide |
| 160 | 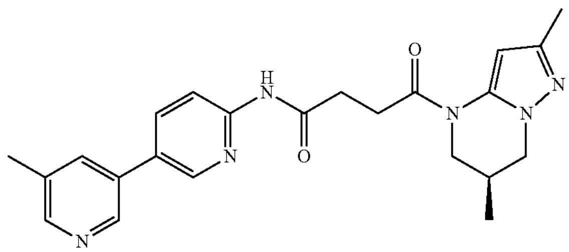 | (S)-4-(2,6-dimethyl-6,7-dihydropyrazolo[1,5-a]pyrimidin-4(5H)-yl)-N-(5'-methyl-[3,3'-bipyridin]-6-yl)-4-oxobutanamide |
| 161 | 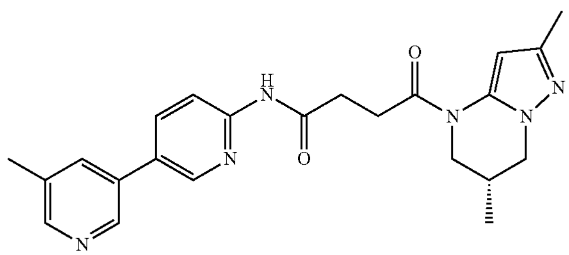 | (R)-4-(2,6-dimethyl-6,7-dihydropyrazolo[1,5-a]pyrimidin-4(5H)-yl)-N-(5'-methyl-[3,3'-bipyridin]-6-yl)-4-oxobutanamide |
| 162 | 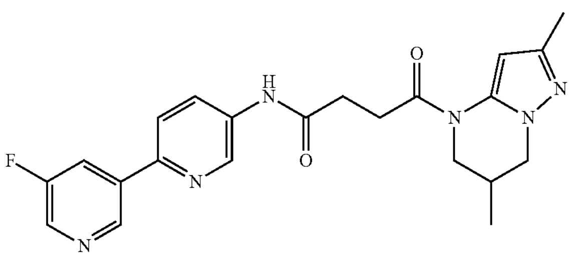 [SMILES: Cc1cc2n(n1)CC(C)CN2C(=O)CCC(=O)Nc1ccc(-c2cncc(F)c2)nc1] | 4-(2,6-dimethyl-6,7-dihydropyrazolo[1,5-a]pyrimidin-4(5H)-yl)-N-(5'-fluoro[2,3'-bipyridin]-5-yl)-4-oxobutanamide |
| 163 | 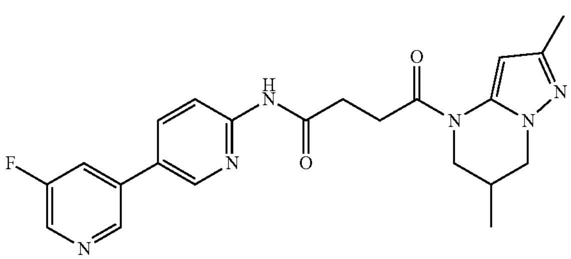 [SMILES: Cc1cc2n(n1)CC(C)CN2C(=O)CCC(=O)Nc1ccc(-c2cncc(F)c2)cn1] | 4-(2,6-dimethyl-6,7-dihydropyrazolo[1,5-a]pyrimidin-4(5H)-yl)-N-(5'-fluoro-[3,3'-bipyridin]-6-yl)-4-oxobutanamide |
| 164 | 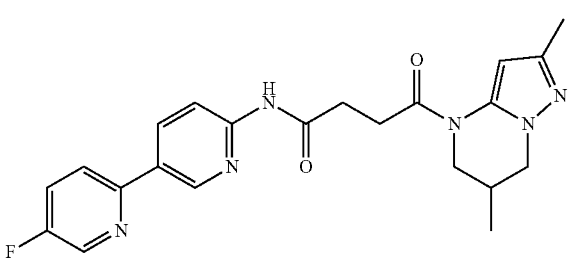 [SMILES: Cc1cc2n(n1)CC(C)CN2C(=O)CCC(=O)Nc1ccc(-c2ccc(F)cn2)cn1] | 4-(2,6-dimethyl-6,7-dihydropyrazolo[1,5-a]pyrimidin-4(5H)-yl)-N-(5-fluoro-[2,3'-bipyridin]-6'-yl)-4-oxobutanamide |

| Cpd ID | Structure | IUPAC Name |
|---|---|---|
| 165 | 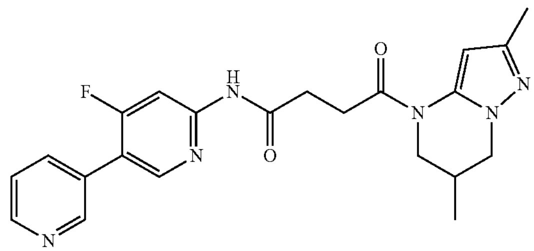 [SMILES: Cc1cc2n(n1)CC(C)CN2C(=O)CCC(=O)Nc1cc(F)c(-c2cccnc2)cn1] | 4-(2,6-dimethyl-6,7-dihydropyrazolo[1,5-a]pyrimidin-4(5H)-yl)-N-(4-fluoro-[3,3'-bipyridin]-6-yl)-4-oxobutanamide |
| 166 | 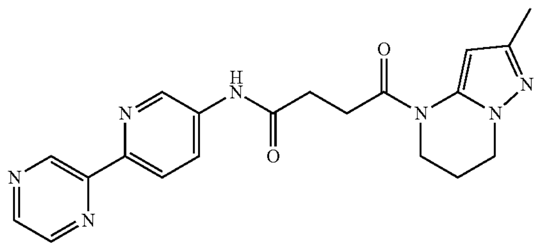 [SMILES: Cc1cc2n(n1)CCCN2C(=O)CCC(=O)Nc1ccc(-c2cnccn2)nc1] | 4-(2-methyl-6,7-dihydropyrazolo[1,5-a]pyrimidin-4(5H)-yl)-4-oxo-N-(6-(pyrazin-2-yl)pyridin-3-yl)butanamide |
| 167 | 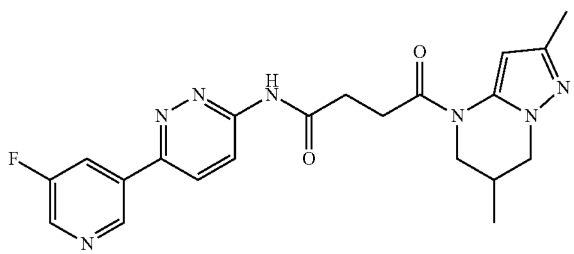 [SMILES: Cc1cc2n(n1)CC(C)CN2C(=O)CCC(=O)Nc1ccc(-c2cncc(F)c2)nn1] | 4-(2,6-dimethyl-6,7-dihydropyrazolo[1,5-a]pyrimidin-4(5H)-yl)-N-(6-(5-fluoropyridin-3-yl)pyridazin-3-yl)-4-oxobutanamide |
| 168 | 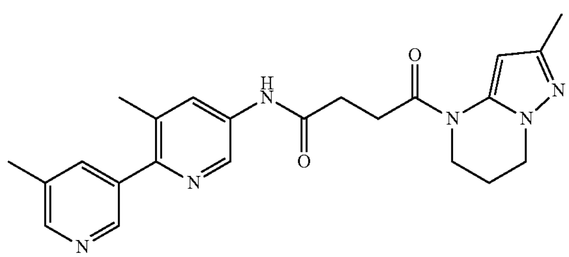 | N-(3,5'-dimethyl-[2,3'-bipyridin]-5-yl)-4-(2-methyl-6,7-dihydropyrazolo[1,5-a]pyrimidin-4(5H)-yl)-4-oxobutanamide |
| 169 | 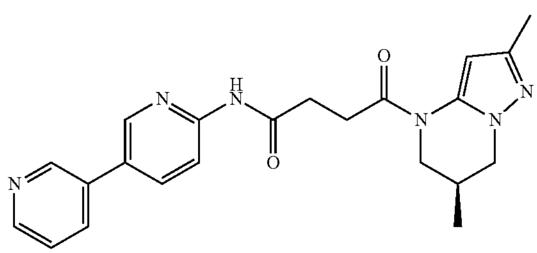 [SMILES: Cc1cc2n(n1)C[C@@H](C)CN2C(=O)CCC(=O)Nc1ccc(-c2cccnc2)cn1] | (S)-N-([3,3'-bipyridin]-6-yl)-4-(2,6-dimethyl-6,7-dihydropyrazolo[1,5-a]pyrimidin-4(5H)-yl)-4-oxobutanamide |
| 170 | 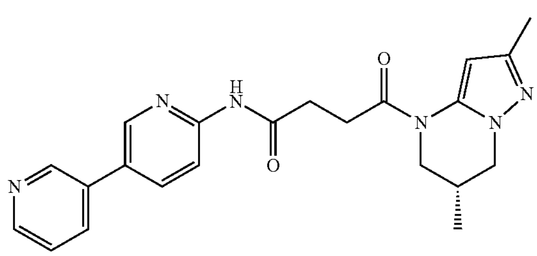 [SMILES: Cc1cc2n(n1)C[C@H](C)CN2C(=O)CCC(=O)Nc1ccc(-c2cccnc2)cn1] | (R)-N-([3,3'-bipyridin]-6-yl)-4-(2,6-dimethyl-6,7-dihydropyrazolo[1,5-a]pyrimidin-4(5H)-yl)-4-oxobutanamide |

| Cpd ID | Structure | IUPAC Name |
|---|---|---|
| 171 | 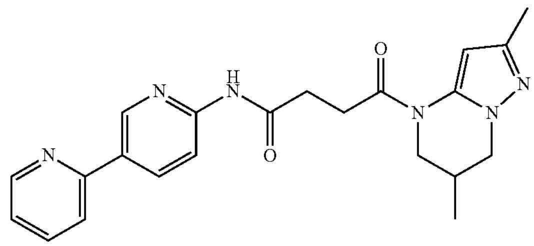 [SMILES: Cc1cc2n(n1)CC(C)CN2C(=O)CCC(=O)Nc1ccc(-c2ccccn2)cn1] | N-([2,3'-bipyridin]-6'-yl)-4-(2,6-dimethyl-6,7-dihydropyrazolo[1,5-a]pyrimidin-4(5H)-yl)-4-oxobutanamide |

The inhibitor of the Wnt signaling pathway may be a porcupine inhibitor. The porcupine inhibitor may be a Wnt-porcupine inhibitor.

The porcupine inhibitor may be 2-(1,3-dimethyl-2,6-dioxo-1,2,3,6-tetrahydro-7H-purin-7-yl)-N-(6-phenylpyridazin-3-yl)acetamide, 2-(1,3-dimethyl-2,6-dioxo-2,3-dihydro-1H-purin-7(6H)-yl)-N-(6-phenylpyridazin-3-yl)acetamide, or a compound of the structure (IV) or may be 4-(2-methyl-6,7-dihydropyrazolol [1,5-a]pyrimidin-4(5H)-yl)-4-oxo-N-(6-(pyridin-3-yl)pyradizin-3-yl)butanamide, or a compound of the structure (V). The porcupine inhibitor may also be compound 5 (ETC-159) of structure (I) or compound 51 (ETC-569) of structure (III).

The porcupine inhibitor may be 2-(1,3-dimethyl-2,6-dioxo-1,2,3,6-tetrahydro-7H-purin-7-yl)-N-(6-phenylpyridazin-3-yl)acetamide, 2-(1,3-dimethyl-2,6-dioxo-2,3-dihydro-1H-purin-7(6H)-yl)-N-(6-phenylpyridazin-3-yl)acetamide, or a compound of the structure (IV). The porcupine inhibitor may also be compound 5 (ETC-159) of structure (I). The porcupine inhibitor may be 4-(2-methyl-6,7-dihydropyrazolol [1,5-a]pyrimidin-4(5H)-yl)-4-oxo-N-(6-(pyridin-3-yl)pyradizin-3-yl)butanamide, or a compound of the structure (V). The porcupine inhibitor may be compound 51 (ETC-569) of structure (III).

The Wnt-porcupine inhibitor may be 2-(1,3-dimethyl-2,6-dioxo-1,2,3,6-tetrahydro-7H-purin-7-yl)-N-(6-phenylpyridazin-3-yl)acetamide, 2-(1,3-dimethyl-2,6-dioxo-2,3-dihydro-1H-purin-7(6H)-yl)-N-(6-phenylpyridazin-3-yl)acetamide, or a compound of the structure (IV) or may be 4-(2-methyl-6,7-dihydropyrazolol [1,5-a]pyrimidin-4(5H)-yl)-4-oxo-N-(6-(pyridin-3-yl)pyradizin-3-yl)butanamide, or a compound of the structure (V). The Wnt-porcupine inhibitor may also be compound 5 (ETC-159) of structure (I) or compound 51 (ETC-569) of structure (III).

The Wnt-porcupine inhibitor may be 2-(1,3-dimethyl-2,6-dioxo-1,2,3,6-tetrahydro-7H-purin-7-yl)-N-(6-phenylpyridazin-3-yl)acetamide, 2-(1,3-dimethyl-2,6-dioxo-2,3-dihydro-1H-purin-7(6H)-yl)-N-(6-phenylpyridazin-3-yl)acetamide, or a compound of the structure (IV). The Wnt-porcupine inhibitor may be 4-(2-methyl-6,7-dihydropyrazolol [1,5-a]pyrimidin-4(5H)-yl)-4-oxo-N-(6-(pyridin-3-yl)pyradizin-3-yl)butanamide, or a compound of the structure (V). The Wnt-porcupine inhibitor may also be compound 5 (ETC-159) of structure (I). The Wnt-porcupine inhibitor may also be compound 51 (ETC-569) of structure (III).

In the development of a drug in solid state form suitable for scale up and cGMP production and ultimately for clinical and commercial use, an acceptable level of drug activity against the target of interest is only one of the important variables that must be considered. For example, in the formulation of pharmaceutical compositions it is imperative that the pharmaceutically active substance be in a form that can be reliably reproduced in a commercial manufacturing process and which is robust enough to withstand the conditions to which the pharmaceutically active substance is exposed.

In a manufacturing sense it is important that during commercial manufacture the manufacturing process of the pharmaceutically active substance be such that the same material is reproduced when the same manufacturing conditions are used. In addition it is desirable that the pharmaceutically active substance exists in a solid form where minor changes to the manufacturing conditions do not lead to major changes in the solid form of the pharmaceutically active substance produced. For example it is important that the manufacturing process produce material having the same crystalline properties on a reliable basis and also produce material having the same level of hydration.

In addition it is important that the pharmaceutically active substance be stable both to degradation, hygroscopicity and subsequent changes to its solid form. This is important to facilitate the incorporation of the pharmaceutically active ingredient into pharmaceutical formulations. If the pharmaceutically active substance is hygroscopic ("sticky") in the sense that it absorbs water (either slowly or over time) it is almost impossible to reliably formulate the pharmaceutically active substance into a drug as the amount of substance to be added to provide the same dosage will vary greatly depending upon the degree of hydration. Furthermore variations in hydration or solid form ("polymorphism") can lead to changes in physico-chemical properties, such as solubility or dissolution rate, which might in turn lead to inconsistent oral absorption in a patient.

Accordingly, chemical stability, solid state stability, and "shelf life" of the pharmaceutically active agent are very important factors. In an ideal situation the pharmaceutically active agent and any compositions containing it, should be capable of being effectively stored over appreciable periods of time, without exhibiting a significant change in the physico-chemical characteristics of the active component such as its activity, moisture content, solubility characteristics, solid form and the like.

The present disclosure also encompasses a pharmaceutical composition comprising the anhydrous free base as described above.

Modulator and inhibitor compounds and agents of the present disclosure may be administered as compositions either therapeutically or preventively. In a therapeutic application, compositions are administered to a patient already suffering from a disease, in an amount sufficient to cure or at least partially arrest the disease and its complications. The composition should provide a quantity of the compound or agent sufficient to effectively treat the patient.

The therapeutically effective dose level for any particular patient will depend upon a variety of factors including: the disorder being treated and the severity of the disorder; activity of the compound or agent employed; the composition employed; the age, body weight, general health, sex and diet of the patient; the time of administration; the route of administration; the rate of sequestration of the agent or compound; the duration of the treatment; drugs used in combination or coincidental with the treatment, together with other related factors well known in medicine.

One skilled in the art would be able, by routine experimentation, to determine an effective, non-toxic amount of agent or compound which would be required to treat applicable diseases.

Generally, an effective dosage is expected to be in the range of about 0.0001 mg to about 1000 mg per kg body weight per 24 hours; typically, about 0.001 mg to about 750 mg per kg body weight per 24 hours; about 0.01 mg to about 500 mg per kg body weight per 24 hours; about 0.1 mg to about 500 mg per kg body weight per 24 hours; about 0.1 mg to about 250 mg per kg body weight per 24 hours; about 1.0 mg to about 250 mg per kg body weight per 24 hours. More typically, an effective dose range is expected to be in the range about 1.0 mg to about 200 mg per kg body weight per 24 hours; about 1.0 mg to about 100 mg per kg body weight per 24 hours; about 1.0 mg to about 50 mg per kg body weight per 24 hours; about 1.0 mg to about 25 mg per kg body weight per 24 hours; about 5.0 mg to about 50 mg per kg body weight per 24 hours; about 5.0 mg to about 20 mg per kg body weight per 24 hours; about 5.0 mg to about 15 mg per kg body weight per 24 hours.

Alternatively, an effective dosage may be up to about 500 mg/m$^2$. Generally, an effective dosage is expected to be in the range of about 25 to about 500 mg/m$^2$, preferably about 25 to about 350 mg/m$^2$, more preferably about 25 to about 300 mg/m$^2$, still more preferably about 25 to about 250 mg/m$^2$, even more preferably about 50 to about 250 mg/m$^2$, and still even more preferably about 75 to about 150 mg/m$^2$.

Typically, in therapeutic applications, the treatment would commonly be for the duration of the disease state.

Further, it will be apparent to one of ordinary skill in the art that the optimal quantity and spacing of individual dosages will be determined by the nature and extent of the disease state being treated, the form, route and site of administration, and the nature of the particular individual being treated. Furthermore, such optimum conditions can be determined by conventional techniques.

It will also be apparent to one of ordinary skill in the art that the optimal course of treatment, such as, the number of doses of the composition given per day for a defined number of days, can be ascertained by those skilled in the art using conventional course of treatment determination tests.

In general, suitable compositions may be prepared according to methods which are known to those of ordinary skill in the art and accordingly may include a pharmaceutically acceptable carrier, diluent and/or adjuvant.

These compositions can be administered by standard routes. In general, the compositions may be administered by the parenteral (e.g., intravenous, intraspinal, subcutaneous or intramuscular), oral or topical route. More preferably administration is by the parenteral route.

The carriers, diluents and adjuvants must be "acceptable" in terms of being compatible with the other ingredients of the composition, and not deleterious to the recipient thereof.

Examples of pharmaceutically acceptable carriers or diluents are demineralised or distilled water; saline solution; vegetable based oils such as peanut oil, safflower oil, olive oil, cottonseed oil, maize oil, sesame oils, *arachis* oil or coconut oil; silicone oils, including polysiloxanes, such as methyl polysiloxane, phenyl polysiloxane and methylphenyl polysolpoxane; volatile silicones; mineral oils such as liquid paraffin, soft paraffin or squalane; cellulose derivatives such as methyl cellulose, ethyl cellulose, carboxymethylcellulose, sodium carboxymethylcellulose or hydroxypropylmethylcellulose; lower alkanols, for example ethanol or isopropanol; lower aralkanols; lower polyalkylene glycols or lower alkylene glycols, for example polyethylene glycol, polypropylene glycol, ethylene glycol, propylene glycol, 1,3-butylene glycol or glycerin; fatty acid esters such as isopropyl palmitate, isopropyl myristate or ethyl oleate; polyvinylpyrridone; agar; carrageenan; gum tragacanth or gum acacia, and petroleum jelly. Typically, the carrier or carriers will form from 10% to 99.9% by weight of the compositions.

The compositions as disclosed herein may be in a form suitable for administration by injection, in the form of a formulation suitable for oral ingestion (such as capsules, tablets, caplets, elixirs, for example), in an aerosol form suitable for administration by inhalation, such as by intranasal inhalation or oral inhalation, in a form suitable for parenteral administration, that is, subcutaneous, intramuscular or intravenous injection.

For administration as an injectable solution or suspension, non-toxic parenterally acceptable diluents or carriers can include, Ringer's solution, isotonic saline, phosphate buffered saline, ethanol and 1,2 propylene glycol.

Some examples of suitable carriers, diluents, excipients and adjuvants for oral use include peanut oil, liquid paraffin, sodium carboxymethylcellulose, methylcellulose, sodium alginate, gum acacia, gum tragacanth, dextrose, sucrose, sorbitol, mannitol, gelatine and lecithin. In addition these oral formulations may contain suitable flavouring and colourings agents. When used in capsule form the capsules may be coated with compounds such as glyceryl monostearate or glyceryl distearate which delay disintegration.

Adjuvants typically include emollients, emulsifiers, thickening agents, preservatives, bactericides and buffering agents.

Solid forms for oral administration may contain binders acceptable in human and veterinary pharmaceutical practice, sweeteners, disintegrating agents, diluents, flavourings, coating agents, preservatives, lubricants and/or time delay agents. Suitable binders include gum acacia, gelatine, corn starch, gum tragacanth, sodium alginate, carboxymethylcellulose or polyethylene glycol. Suitable sweeteners include sucrose, lactose, glucose, aspartame or saccharine. Suitable disintegrating agents include corn starch, methylcellulose, polyvinylpyrrolidone, guar gum, xanthan gum, bentonite, alginic acid or agar. Suitable diluents include lactose, sorbitol, mannitol, dextrose, kaolin, cellulose, calcium carbonate, calcium silicate or dicalcium phosphate. Suitable flavouring agents include peppermint oil, oil of wintergreen, cherry, orange or raspberry flavouring. Suitable coating agents include polymers or copolymers of acrylic acid and/or methacrylic acid and/or their esters, waxes, fatty alcohols, zein, shellac or gluten. Suitable preservatives include sodium benzoate, vitamin E, alpha-tocopherol, ascorbic acid, methyl paraben, propyl paraben or sodium bisulphite. Suitable lubricants include magnesium stearate, stearic acid, sodium oleate, sodium chloride or talc. Suitable time delay agents include glyceryl monostearate or glyceryl distearate.

Liquid forms for oral administration may contain, in addition to the above agents, a liquid carrier. Suitable liquid carriers include water, oils such as olive oil, peanut oil, sesame oil, sunflower oil, safflower oil, arachis oil, coconut oil, liquid paraffin, ethylene glycol, propylene glycol, polyethylene glycol, ethanol, propanol, isopropanol, glycerol, fatty alcohols, triglycerides or mixtures thereof.

Suspensions for oral administration may further comprise dispersing agents and/or suspending agents. Suitable suspending agents include sodium carboxymethylcellulose, methylcellulose, hydroxypropylmethyl-cellulose, poly-vinyl-pyrrolidone, sodium alginate or acetyl alcohol. Suitable dispersing agents include lecithin, polyoxyethylene esters of fatty acids such as stearic acid, polyoxyethylene sorbitol mono- or di-oleate, -stearate or -laurate, polyoxyethylene sorbitan mono- or di-oleate, -stearate or -laurate and the like.

The emulsions for oral administration may further comprise one or more emulsifying agents. Suitable emulsifying agents include dispersing agents as exemplified above or natural gums such as guar gum, gum acacia or gum tragacanth.

Methods for preparing parenterally administrable compositions are apparent to those skilled in the art.

The composition may incorporate any suitable surfactant such as an anionic, cationic or non-ionic surfactant such as sorbitan esters or polyoxyethylene derivatives thereof. Suspending agents such as natural gums, cellulose derivatives or inorganic materials such as silicaceous silicas, and other ingredients such as lanolin, may also be included.

The compositions may also be administered in the form of liposomes. Liposomes are generally derived from phospholipids or other lipid substances, and are formed by mono- or multi-lamellar hydrated liquid crystals that are dispersed in an aqueous medium. Any non-toxic, physiologically acceptable and metabolisable lipid capable of forming liposomes can be used. The compositions in liposome form may contain stabilisers, preservatives, excipients and the like. The preferred lipids are the phospholipids and the phosphatidyl cholines (lecithins), both natural and synthetic. Methods to form liposomes are known in the art.

The oral formulation may be formulated with one or more pharmacologically acceptable ingredients to make a tablet or capsule etc. with an enteric coating. Methods for such formulations are well known to those skilled in the art. The enteric coating may be an enteric coating which enhances delivery of the composition or active(s) drugs to specific regions of the gastrointestinal tract for enhanced bioavailability, such as are described in United States of America Patent Application Publication No. 20040162263 entitled "Pharmaceutical formulations targeting specific regions of the gastrointestinal tract" to Sands et al and published 19 Aug. 2004.

As used herein, the singular form "a", "an" and "the" include plural references unless the context clearly dictates otherwise. For example, the term "a primer" includes a plurality of primers, including mixtures thereof.

As used herein, the term "about", in the context of concentrations of components of the formulations, typically means +/−5% of the stated value, more typically +/−4% of the stated value, more typically +/−3% of the stated value, more typically, +/−2% of the stated value, even more typically +/−1% of the stated value, and even more typically +/−0.5% of the stated value. When used in the context of duration of time, the term "about" typically means +/−20% of the stated time, more typically +/−15% of the stated time, more typically +/−10% of the stated time, more typically, +/−5% of the stated time, even more typically +/−2% of the stated time, and even more typically +/−1% of the stated time. For example, when the stated duration of time is 1 day, the term "about 1 day" could refer to 1 day +/−0 to 6 hours. As another example, when the stated duration of time is 1 hour, the term "about 1 hour" could refer to 1 hour +/−0 to 10 minutes.

Throughout this disclosure, certain examples may be disclosed in a range format. It should be understood that the description in range format is merely for convenience and brevity and should not be construed as an inflexible limitation on the scope of the disclosed ranges. Accordingly, the description of a range should be considered to have specifically disclosed all the possible sub-ranges as well as individual numerical values within that range. For example, description of a range such as from 1 to 6 should be considered to have specifically disclosed sub-ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The invention illustratively described herein may suitably be practiced in the absence of any element or elements, limitation or limitations, not specifically disclosed herein. Thus, for example, the terms "comprising", "including", "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein.

Other embodiments are within the following claims and non-limiting examples. In addition, where features or aspects of the invention are described in terms of Markush groups, those skilled in the art will recognize that the invention is also thereby described in terms of any individual member or subgroup of members of the Markush group.

EXPERIMENTAL SECTION

Example 1—PCR Protocol for Single-Plexed PTPRK(e1)+RSPO3(e2) Fusion Positive Control Verification PCR Reagent SuperScript III Platinum One-Step Quantitative RT-PCR System (Cat #11732-020 for 100 reactions, Cat #11732-088 for 500 reactions, Invitrogen)

Master Mix Preparation

The master mix for the PCR reaction is prepared as set out in Table 1 (reaction volume=25 µl).

TABLE 1

|  | Description | µl in each 25 µl reaction |
|---|---|---|
| Primer & Probes | PTPRK(e1) + RSPO3(e2) fusion primer-probe mix (SEQ ID NO: 6, 7 and 46) | 1.00 |
|  | Internal control primer-probe mix (SEQ ID NO: 16, 17 and 50) | 1.00 |
| Reagents | SuperScriptIII RT/Plt Taq mix (50x) | 0.50 |
|  | Reaction mix (2x) | 12.50 |
|  | Internal control template | 0.10 |
|  | Nuclease-free water | 7.40 |
| Test sample | PTPRK(e1) + RSPO3(e2) fusion positive control plasmid | 2.50 |
|  | Total Volume | 25 |

RT-PCR Cycling Conditions

TABLE 2

| Step | Temp (° C.) net (sec) | Bio-Rad CFX96 real-time PCR detection system Duration | No. of Cycle(s) |
|---|---|---|---|
| 1 | 55 | 10 min | 1 |
| 2 | 95 | 2 min 30 secs | 1 |
| 3 | 95 | 17 secs | 42 |
|  | 56* | 31 secs |  |
|  | 68 | 32 secs |  |

*Perform fluorescence data collection here.

Data Analysis

TABLE 3

|  | Target | Dye/Channel | Threshold |
|---|---|---|---|
| 1 | PTPRK(e1) + RSPO3(e2) fusion | FAM | 50 RFU |
| 2 | Internal Control | HEX | 25 RFU |

Figure 4:
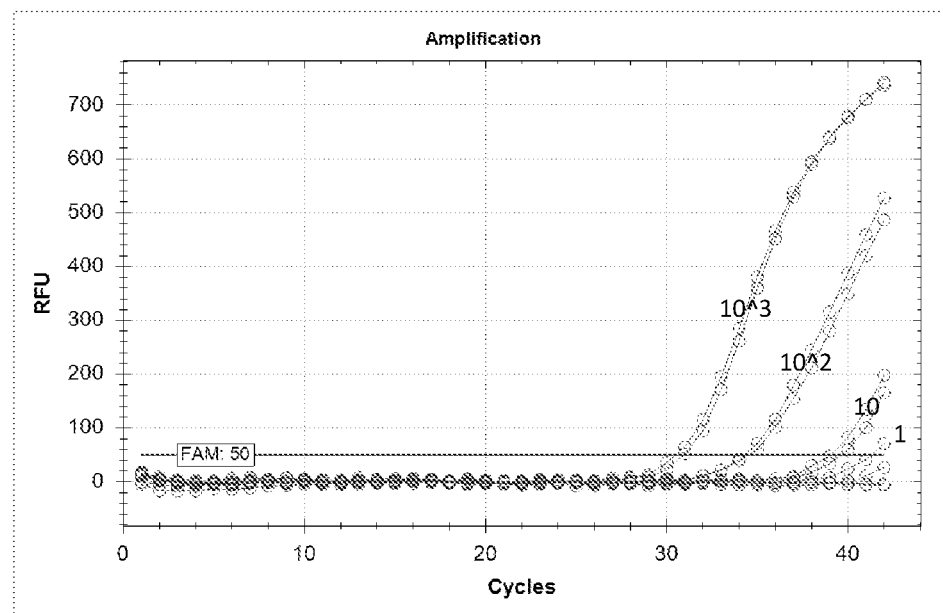
FIG. 4 shows the amplification plots of PTPRK(e1)+RSPO3(e2) fusion (A) and the internal control (B). Each sample contains 100 copies of the internal control plasmids and 1000, 100, 10 or 1 copies of the positive control plasmid respectively. The results show that the PCR amplification reactions designed can successfully amplify the PTPRK(e1)+RSPO3(e2) fusion positive control plasmids and the internal control plasmids.
Figure 4:
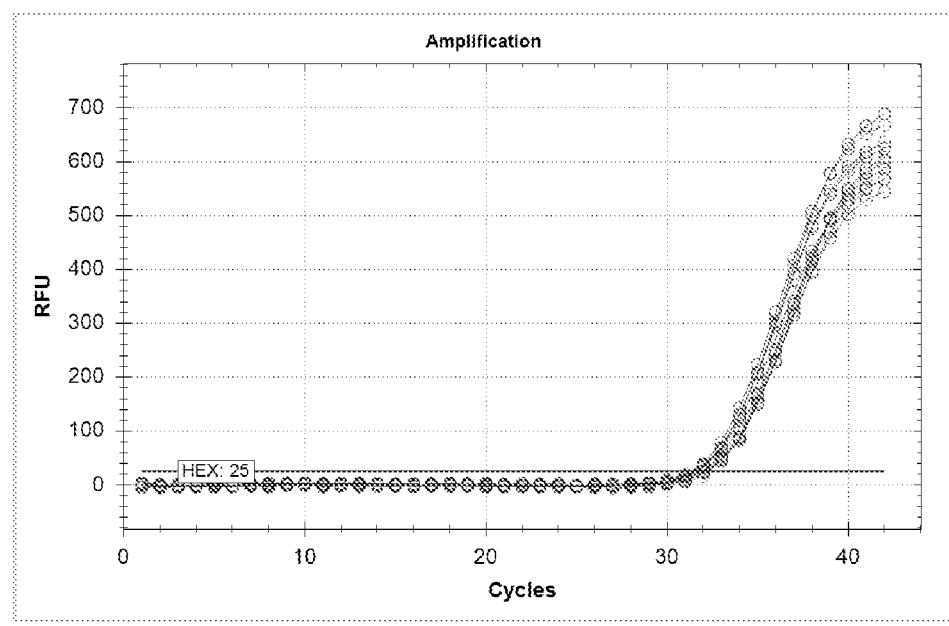

To set up the amplification curves for the PTPRK(e1)+RSPO3(e2) fusion, serial dilution of the positive control plasmids containing the PTPRK(e1)+RSPO3(e2) fusion is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmid and the internal control are shown in FIGS. 4A and 4B, with the respective Ct values indicated below each amplification plot.

Example 2—PCR Protocol for Single-Plexed PTPRK(e1/e2) Wild-Type Positive Plasmid Control Verification and the Single-Plexed Detection of PTPRK(e1/e2) Wild-Type in Human Total RNA The PCR reagent used is the same as in Example 1.

Master Mix Preparation

The master mix for the PCR reaction is prepared as set out in Table 4 (reaction volume=25 µl).

TABLE 4

|  | Description | µl in each 25 µl reaction |
|---|---|---|
| Primer & Probes | PTPRK(e1/e2) wild-type primer-probe mix (SEQ ID NO: 22; 23 or 24; and 47 or 48) | 1.00 |
|  | Internal control primer-probe mix (SEQ ID NO: 16, 17 and 50) | 1.00 |
| Reagents | SuperScriptIII RT/Plt Taq mix (50x) | 0.50 |
|  | Reaction mix (2x) | 12.50 |
|  | Internal control template | 0.10 |
|  | Nuclease-free water | 7.40 |
| Test sample | PTPRK(e1/e2) wild-type positive control plasmid or Human XpressRef Universal Total RNA 2 ng/µl (Cat#: 338112, Qiagen) | 2.50 |
|  | Total Volume | 25 |

The RT-PCR cycling conditions are the same as in Example 1.

Data Analysis

TABLE 5

|  | Target | Dye/Channel | Threshold |
|---|---|---|---|
| 1 | PTPRK(e1/e2) wild-type | TxRd | 50 RFU |
| 2 | Internal Control | HEX | 25 RFU |

Figure 5:
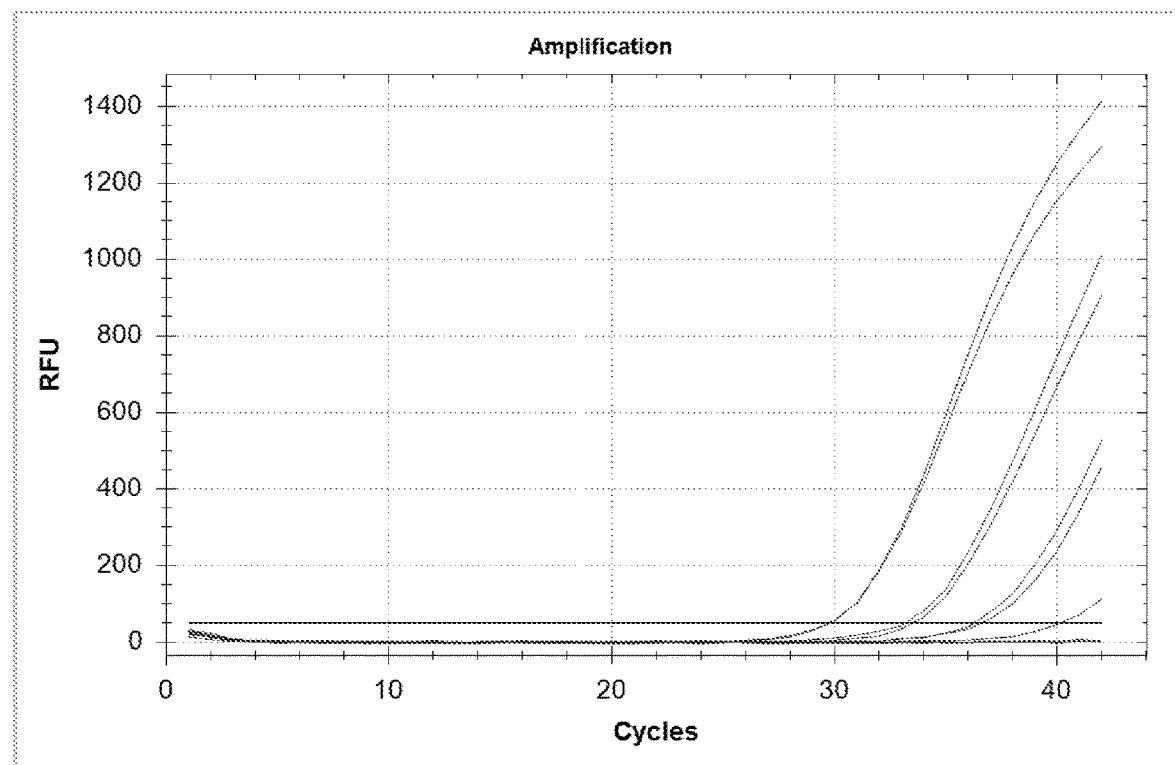
FIG. 5 shows the amplification plots of PTPRK(e1/e2) wild-type in samples containing the PTPRK(e1/e2) wild-type positive control plasmids (A) and in samples containing human total RNA (C).
Figure 5:
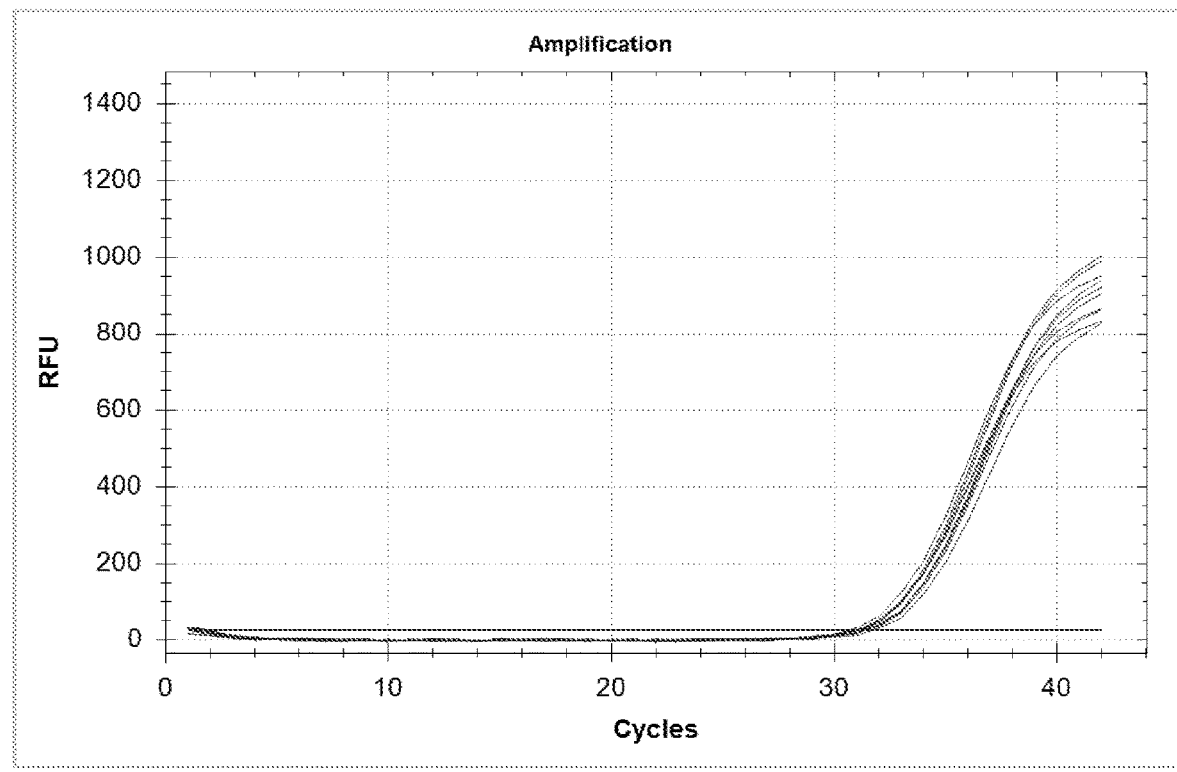
Figure 5:
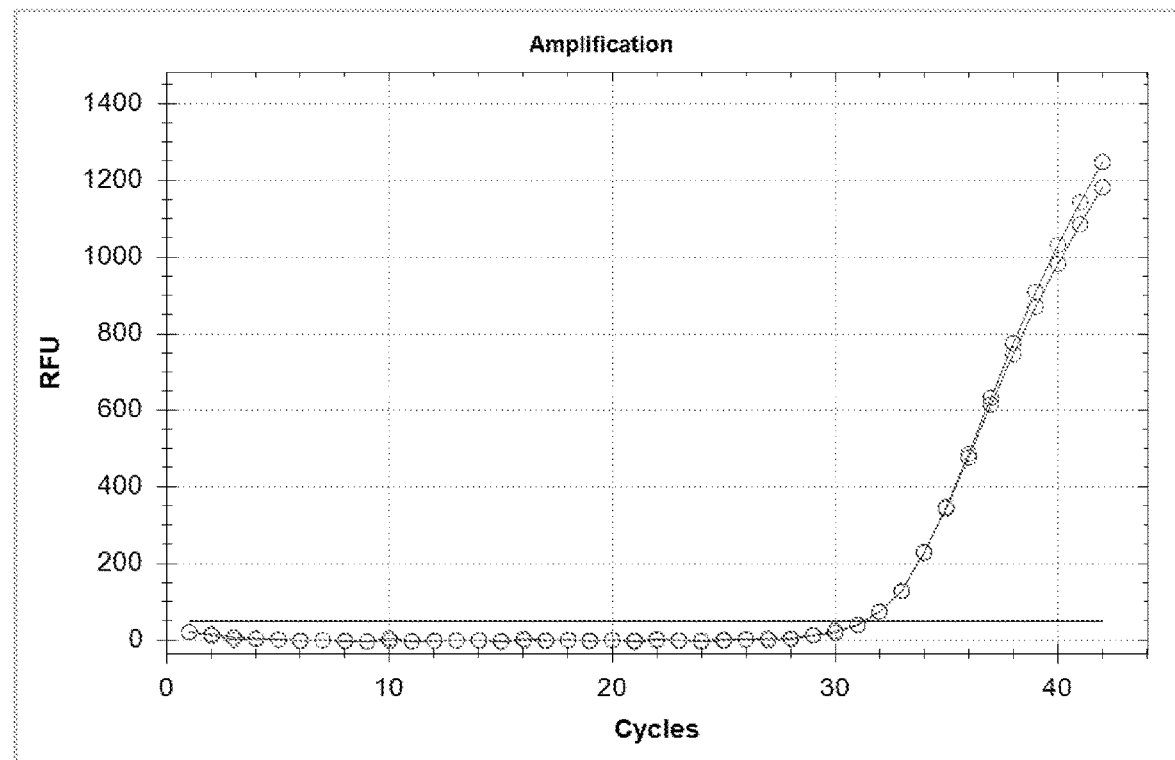
Figure 5:
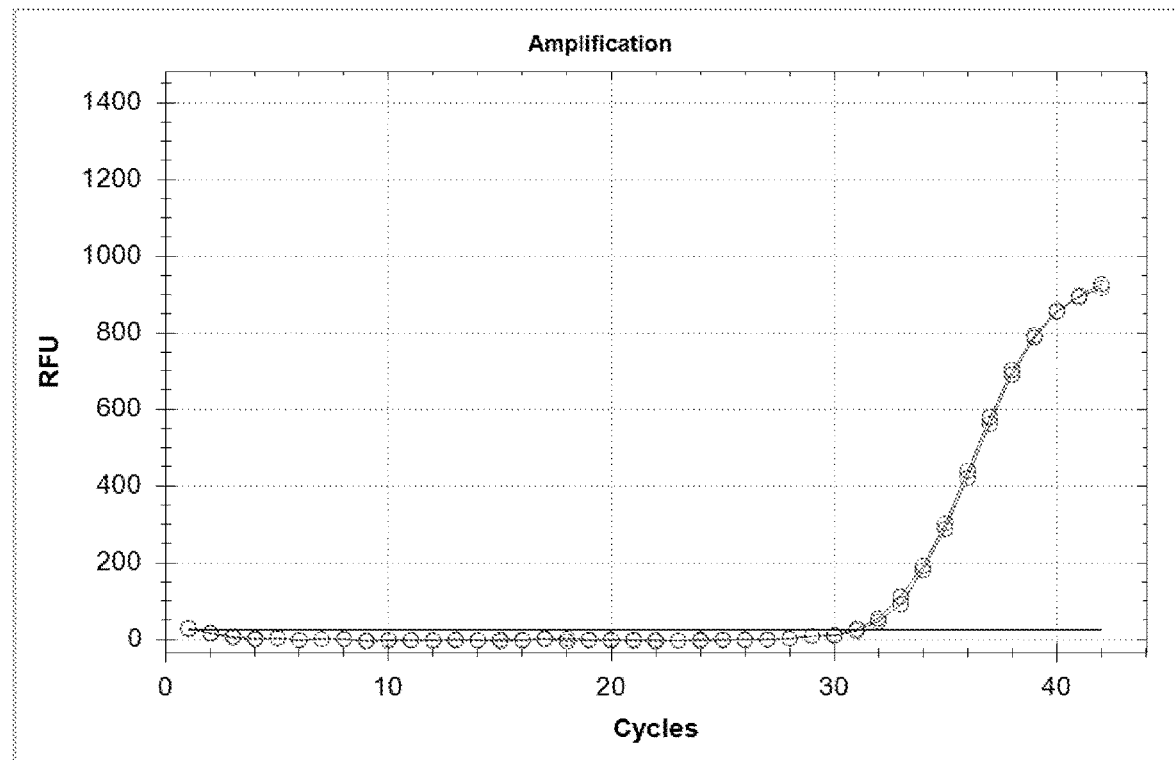
Figure 5:
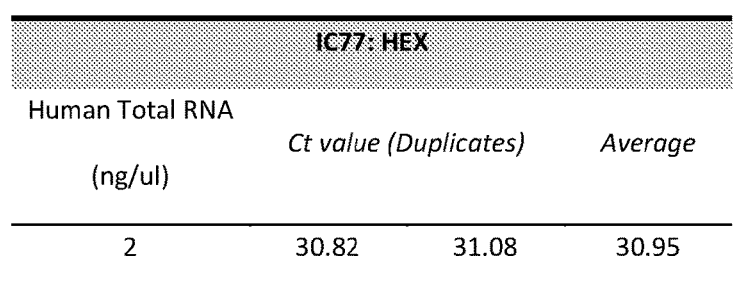

To set up the amplification curves for the PTPRK(e1/e2) wild-type, serial dilution of the positive control plasmids containing the PTPRK(e1/e2) wild-type is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmids and the internal control are shown in FIGS. 5A and 5B, the amplification plots of PTPRK(e1/e2) wild-type and the internal control in the samples containing the human total RNAs are shown in FIGS. 5C and 5D. The respective Ct values are indicated below each amplification plot.

Example 3—PCR Protocol for Single-Plexed RSPO3(e1/e2) Wild-Type Positive Plasmid Control Verification and the Single-Plexed Detection of RSPO3(e1/e2) Wild-Type in Human Total RNA The PCR reagent used is the same as in Example 1.
Master Mix Preparation
The master mix for the PCR reaction is prepared as set out in Table 6 (reaction volume=25 μl).

TABLE 6

| | Description | μl in each 25 μl reaction |
|---|---|---|
| Primer & Probes | RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | RSPO3(e1/e2) wild-type positive control plasmid or Human XpressRef Universal Total RNA 2 ng/μl (Cat#: 338112, Qiagen) | 2.50 |
| | Total Volume | 25 |

The RT-PCR cycling conditions are the same as in Example 1.
Data Analysis

TABLE 7

| | Target | Dye/Channel | Threshold |
|---|---|---|---|
| 1 | RSPO3 (e1/e2) wild-type | Cy5 | 50 RFU |
| 2 | Internal Control | HEX | 25 RFU |

Figure 6:
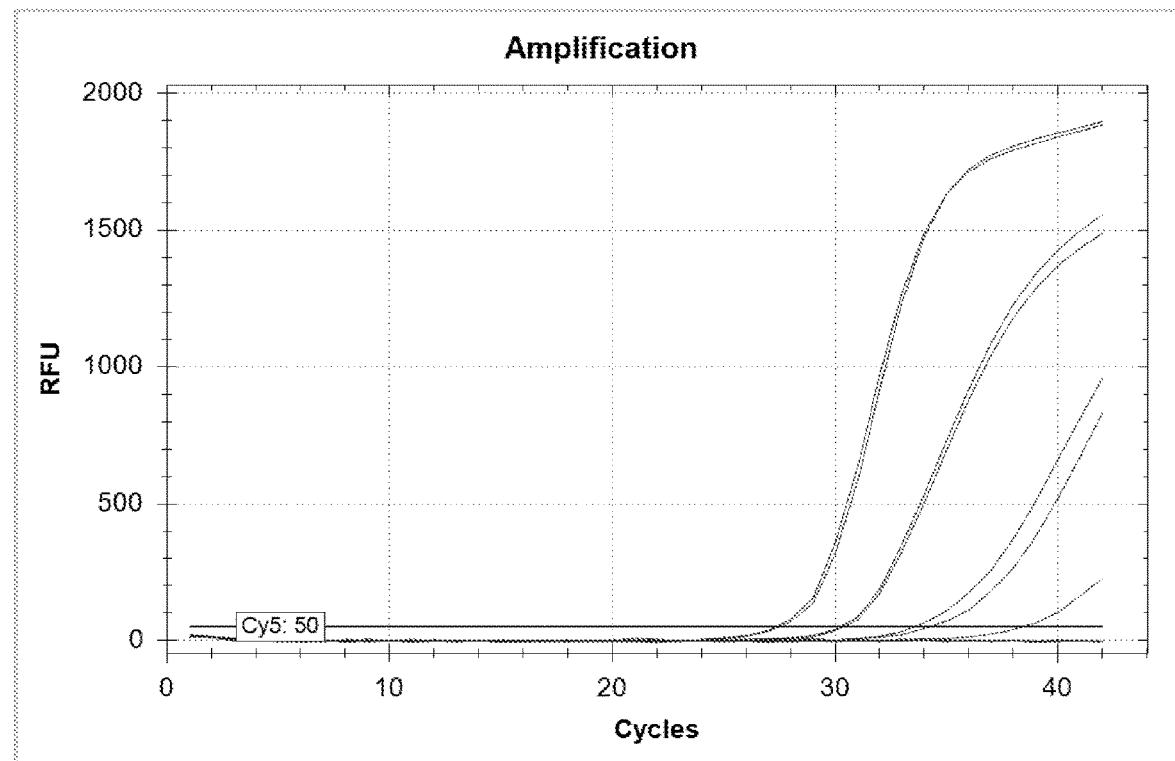
FIG. 6 shows the amplification plots of RSPO3(e1/e2) wild-type in samples containing the RSPO3(e1/e2) wild-type positive control plasmids (A) and in samples containing human total RNA (C).
Figure 6:
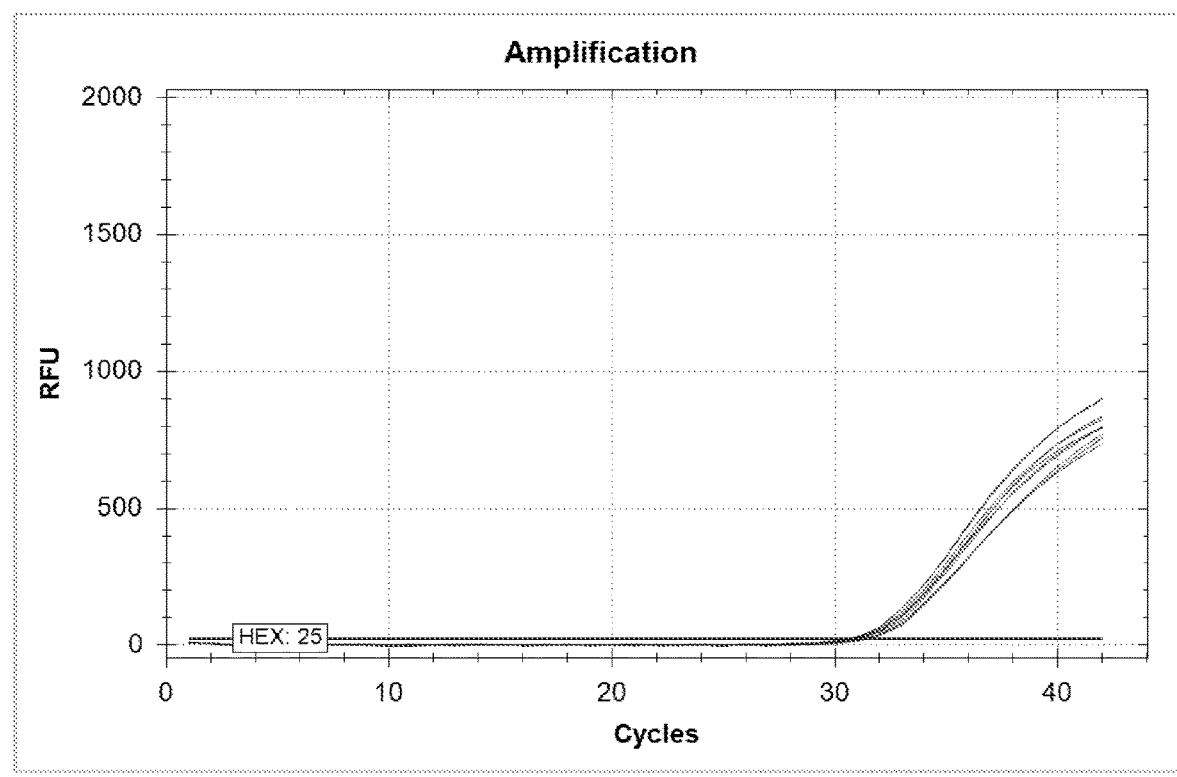
Figure 6:
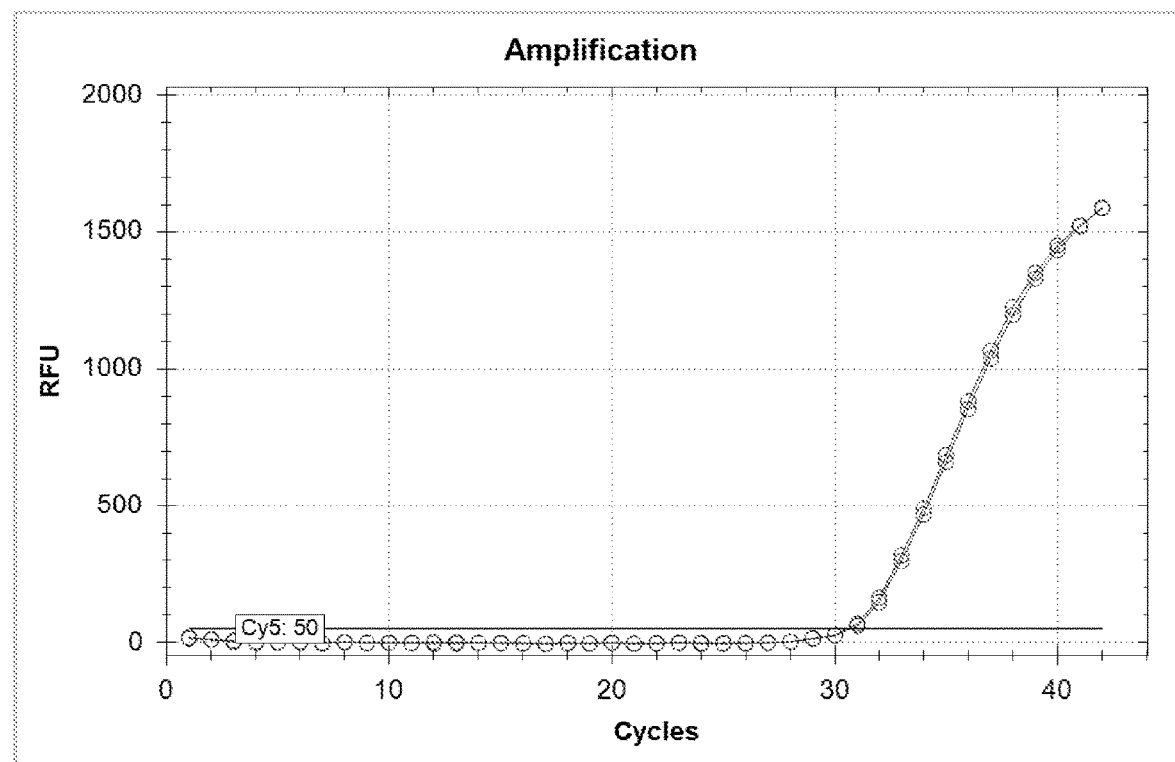
Figure 6:
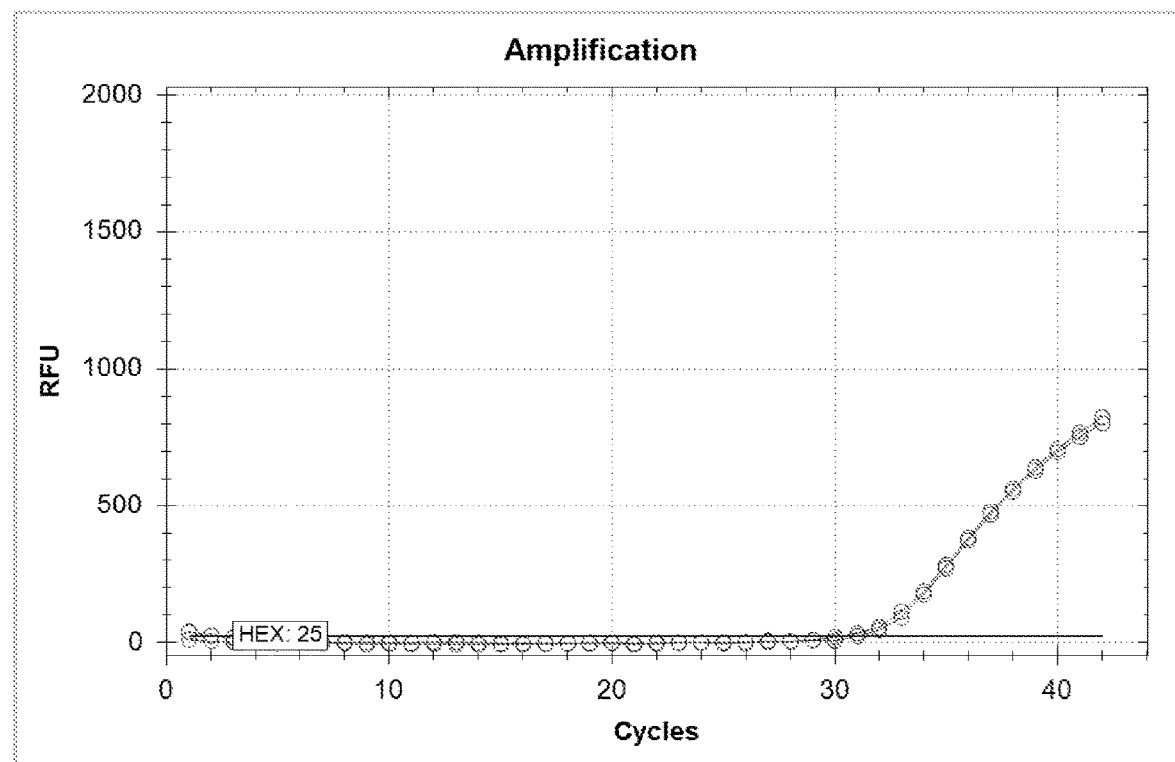

To set up the amplification curves for the RSPO3(e1/e2) wild-type, serial dilution of the positive control plasmids containing the RSPO3(e1/e2) wild-type is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmids and the internal control are shown in FIGS. 6A and 6B, the amplification plots of RSPO3(e1/e2) wild-type and the internal control in the samples containing the human total RNAs are shown in FIGS. 6C and 6D. The respective Ct values are indicated below each amplification plot.

Example 4—PCR Protocol for Multiplexed PTPRK(e1)+RSPO3(e2) Fusion Positive Control Verification and Comparison with the Single-Plexed Protocol The PCR reagent used is the same as in Example 1.
Master Mix Preparation
The master mix for the PCR reaction is prepared as set out in Table 8 (reaction volume=25 μl).

TABLE 8

| | Description | μl in each 25 μl reaction |
|---|---|---|
| Primer & Probes | PTPRK(e1) + RSPO3(e2) fusion primer-probe mix (SEQ ID NO: 6, 7 and 46), | 1.00 |
| | PTPRK(e1/e2) wild-type primer-probe mix (SEQ ID NO: 22; 23 or 24; and 47 or 48), and | |
| | RSPO3(e1/e2) wild-type primer-probe mix (SEQ ID NO: 12; 13 or 14; and 49) | |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | PTPRK(e1) + RSPO3(e2) fusion positive control plasmid | 2.50 |
| | Total Volume | 25 |

The RT-PCR cycling conditions are the same as in Example 1.
Data Analysis

TABLE 9

| | Target | Dye/Channel | Threshold |
|---|---|---|---|
| 1 | PTPRK(e1) + RSPO3(e2) fusion | FAM | 50 RFU |
| 2 | Internal Control | HEX | 25 RFU |

Figure 7:
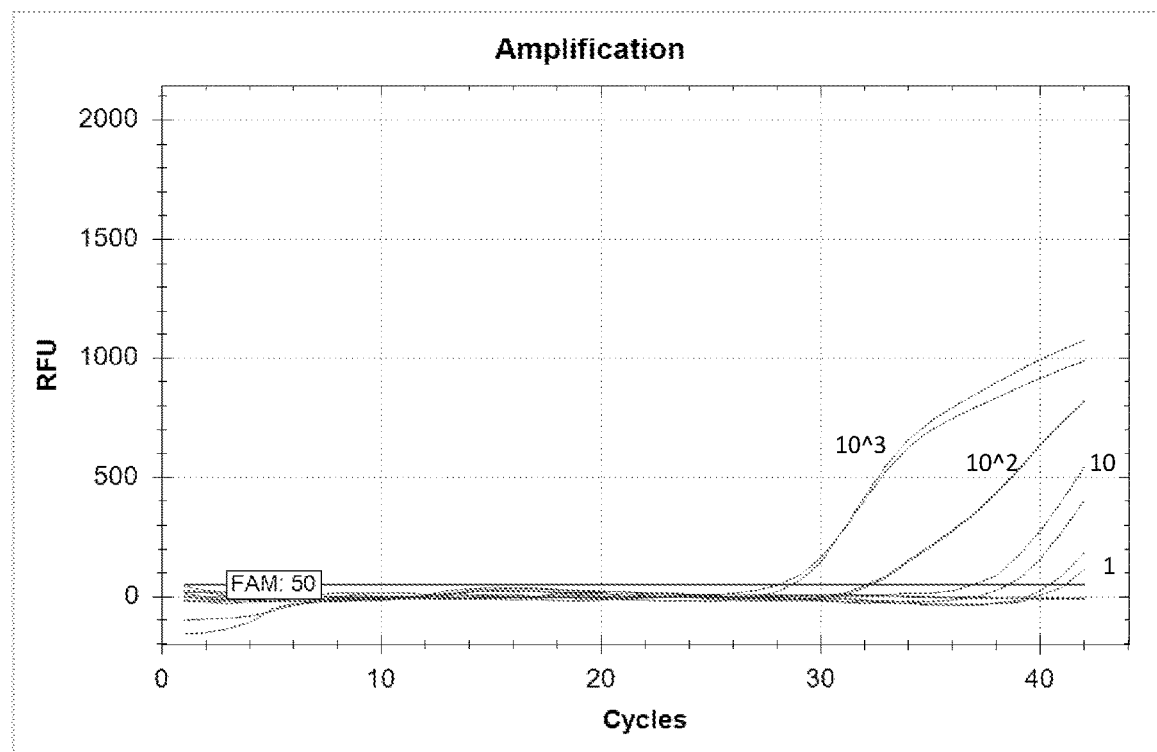
FIG. 7 shows the multiplexed amplification plots of the PTPRK(e1)+RSPO3(e2) fusion (A) and the internal control plasmid (C) in the samples containing the serially diluted positive control plasmids and the internal control. The single-plexed amplification plots of the PTPRK(e1)+RSPO3(e2) fusion (B) and the internal control plasmid (D) in the samples containing the serially diluted positive control plasmids and the internal control are also shown. The results show that in general, the multiplexed amplification reactions are more sensitive than the single-plexed reactions, as indicated by the negative $\Delta Ct$ values.
Figure 7:
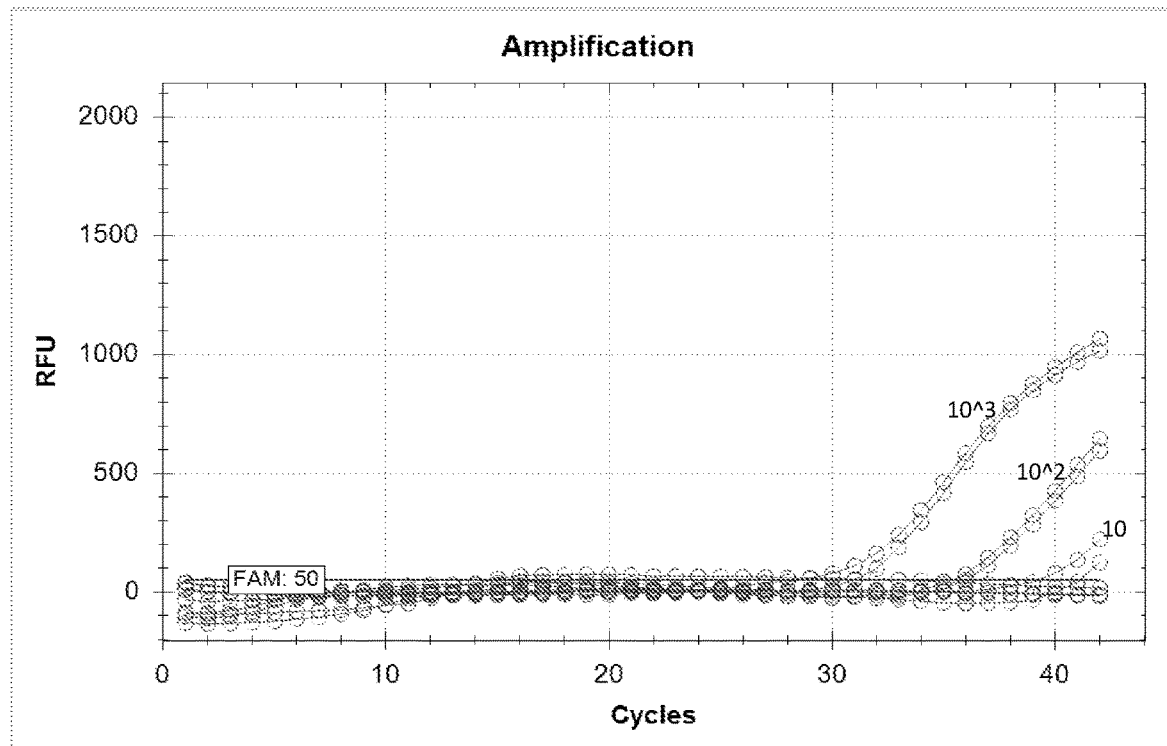
Figure 7:
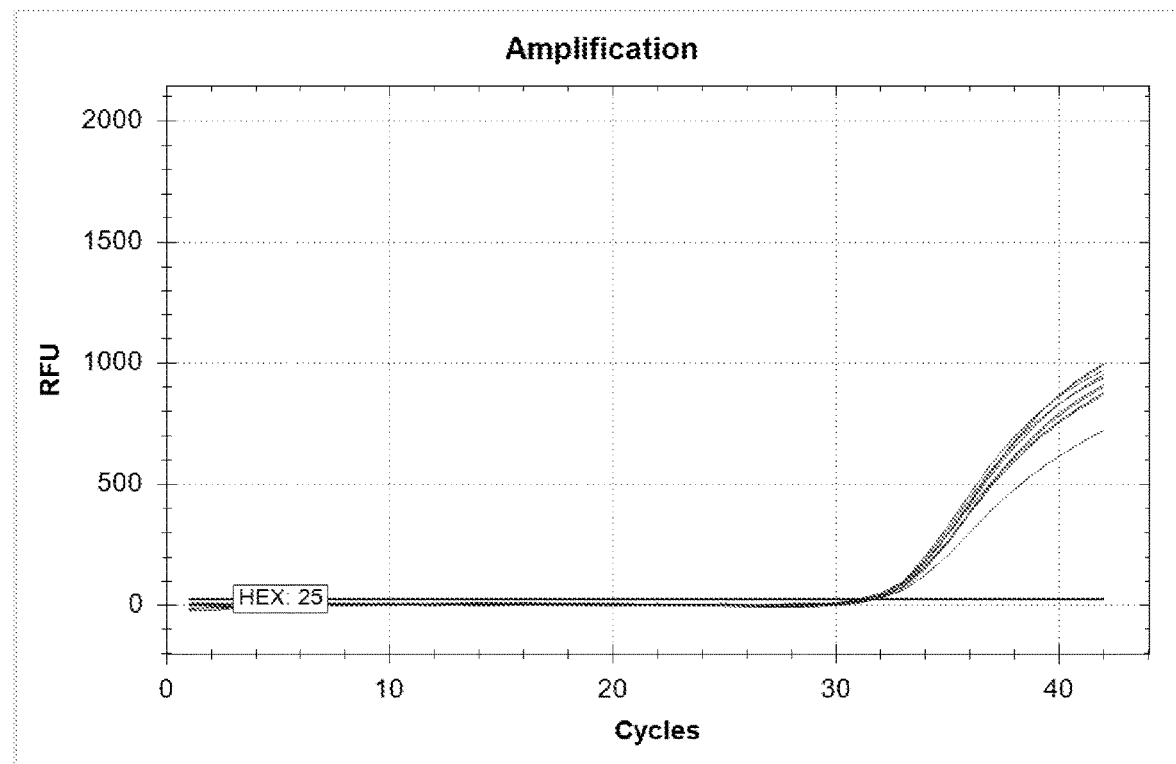
Figure 7:
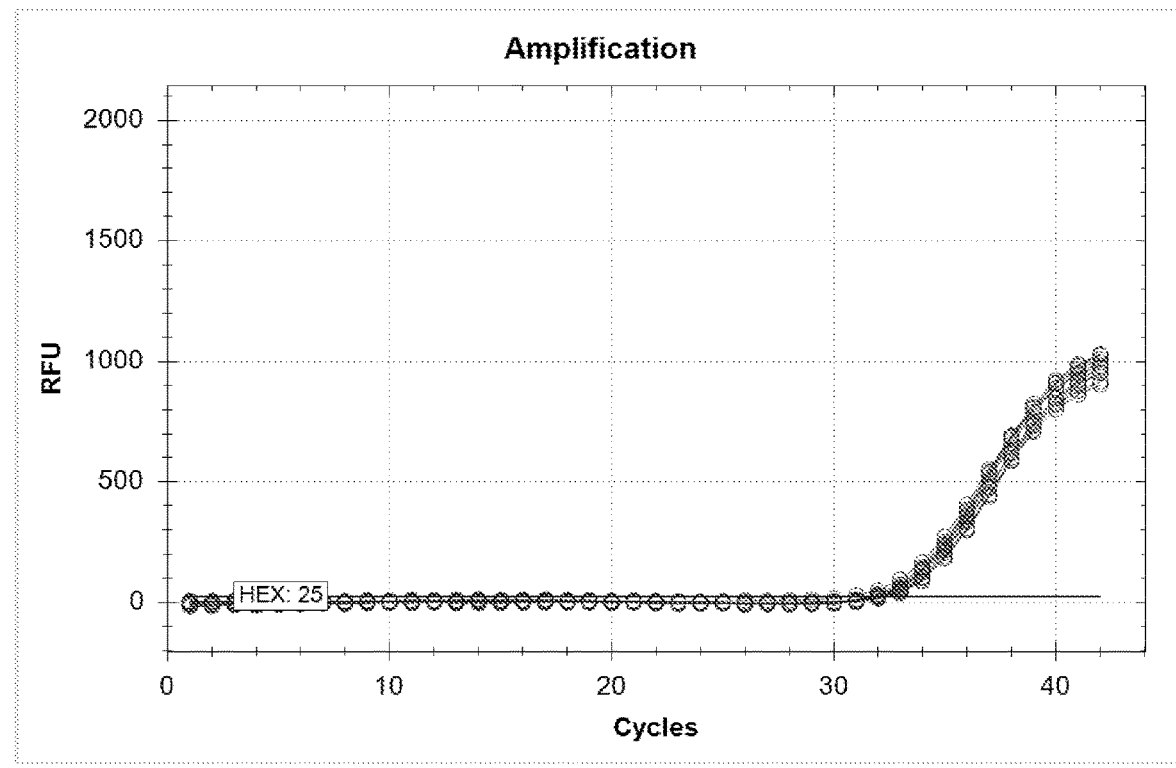

To set up the amplification curves for the PTPRK(e1)+RSPO3(e2) fusion, serial dilution of the positive control plasmids containing the PTPRK(e1)+RSPO3(e2) fusion is carried out, such that the samples for the positive control plasmids contain 1000, 100, 10 and 1 copies of the positive control plasmid respectively. The multiplexed amplification plots of the samples containing the serially diluted positive control plasmids and the internal control are shown in FIGS. 7A and 7C. The single-plexed amplification plots of the samples containing the serially diluted positive control plasmids and the internal control are shown in FIGS. 7B and 7D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e1)+RSPO3(e2) fusion is −2.44, with the Ct value for samples with 1 plasmid copy/μl excluded from calculation. The average ΔCt value calculated for the detection of the internal control is −0.41.

Example 5—PCR Protocol for Multiplexed PTPRK(e1/e2) Wild-Type Positive Plasmid Control Verification and Comparison with the Single-Plexed Protocol The PCR reagent used is the same as in Example 1.
Master Mix Preparation
The master mix for the PCR reaction is prepared as set out in Table 10 (reaction volume=25 μl)

TABLE 10

| | Description | μl in each 25 μl reaction |
|---|---|---|
| Primer & Probes | PTPRK(e1) + RSPO3(e2) fusion primer-probe mix (SEQ ID NO: 6, 7 and 46), | 1.00 |

TABLE 10-continued

| | Description | μl in each 25 μl reaction |
|---|---|---|
| | PTPRK(e1/e2) wild-type primer-probe mix (SEQ ID NO: 22; 23 or 24; and 47 or 48), and RSPO3(e1/e2) wild-type primer-probe mix (SEQ ID NO: 12; 13 or 14; and 49) | |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | PTPRK(e1/e2) wild-type positive control plasmid | 2.50 |
| | Total Volume | 25 |

The RT-PCR cycling conditions are the same as in Example 1.

Data Analysis

TABLE 11

| | Target | Dye/Channel | Threshold |
|---|---|---|---|
| 1 | PTPRK(e1/e2) wild-type | TxRd | 50 RFU |
| 2 | Internal Control | HEX | 25 RFU |

Figure 8:
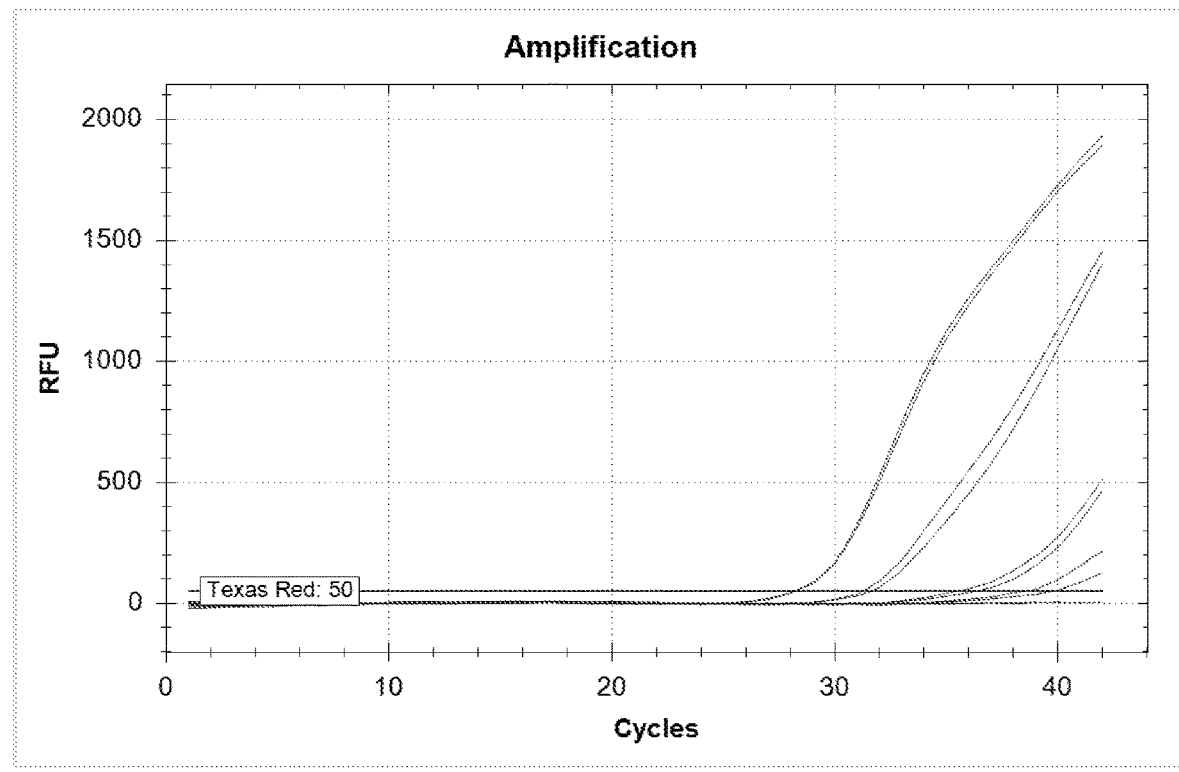
FIG. 8 shows the multiplexed amplification plots of the PTPRK(e1/e2) wild-type (A) and the internal control plasmid (C) in the samples containing the serially diluted positive control plasmids and the internal control. The single-plexed amplification plots of the PTPRK(e1/e2) wild-type (B) and the internal control plasmid (D) in the samples containing the serially diluted positive control plasmids and the internal control are also shown. The results show that in general, the multiplexed amplification reactions are more sensitive than the single-plexed reactions, as indicated by the negative $\Delta Ct$ values.
Figure 8:
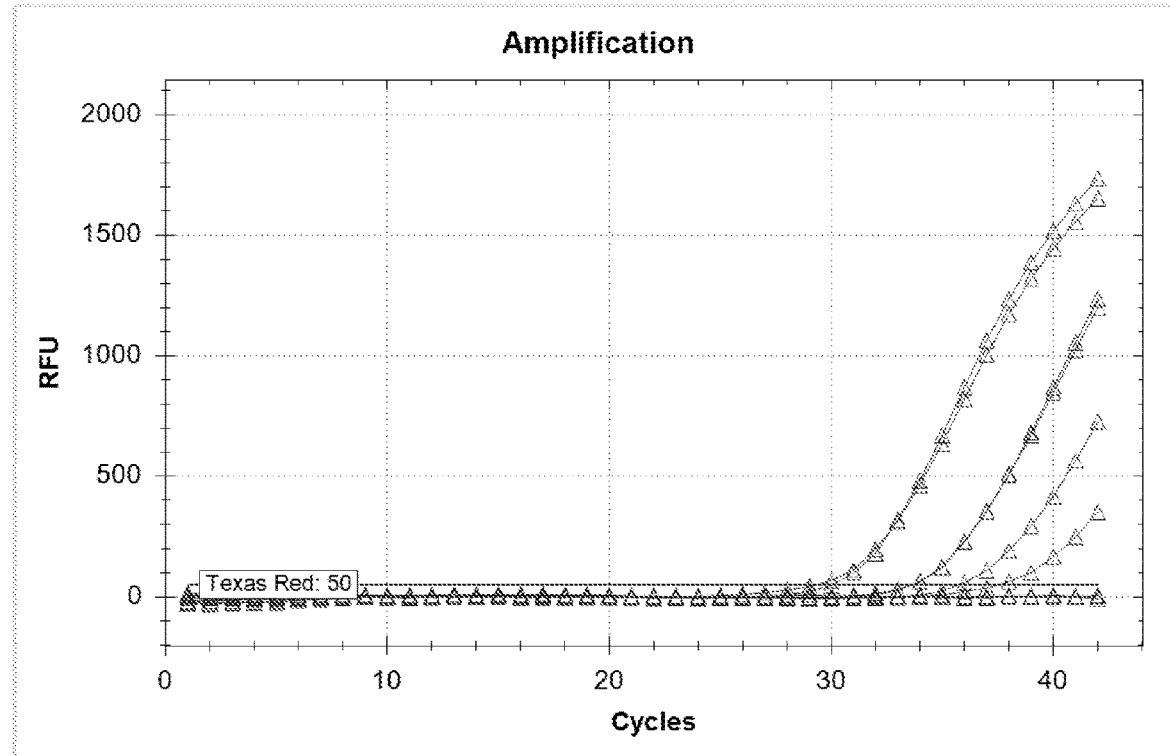
Figure 8:
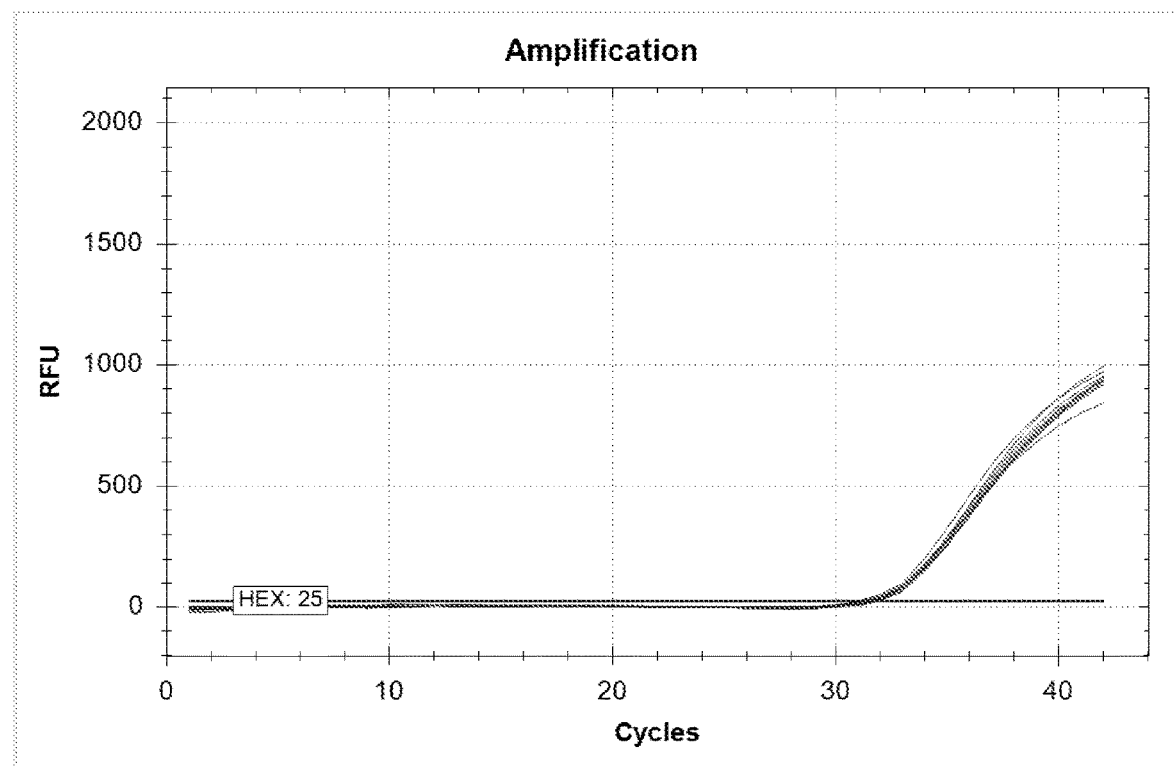
Figure 8:
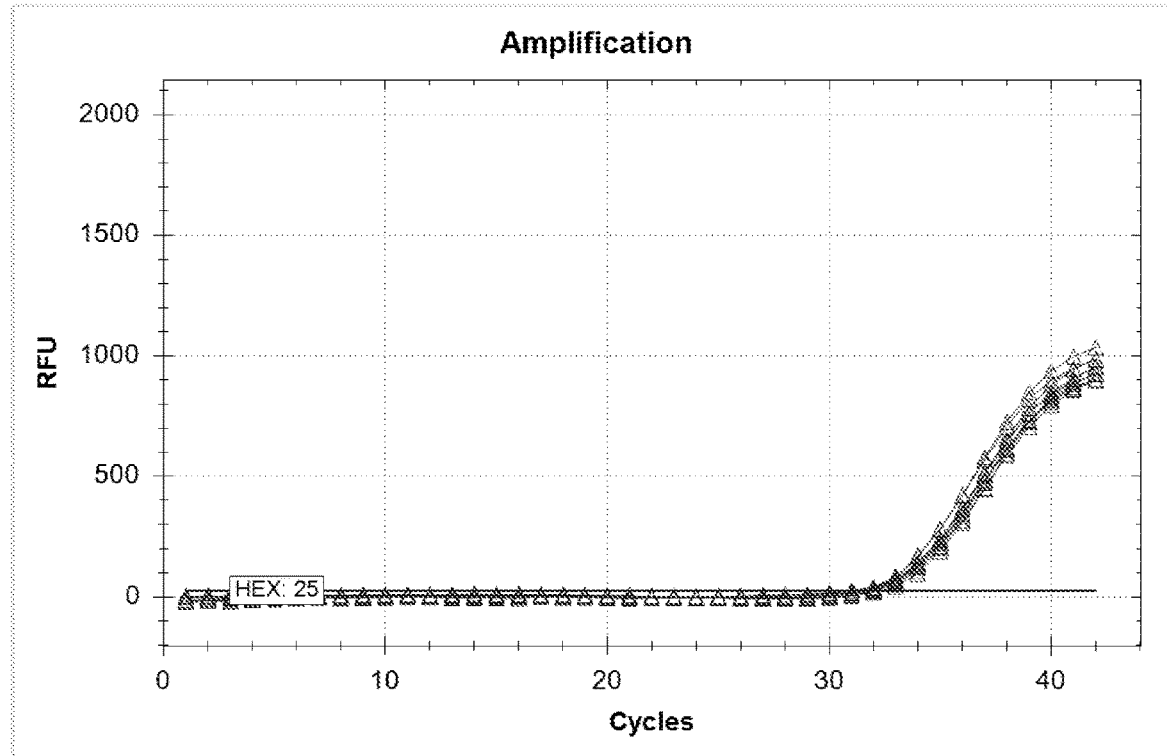

To set up the amplification curves for the PTPRK(e1/e2) wild-type, serial dilution of the positive control plasmids containing the PTPRK(e1/e2) wild-type is carried out, such that the samples for the positive control plasmids contain 1000, 100, 10 and 1 copies of the positive control plasmid respectively. 100 copies of the internal control plasmid is added in each sample. The multiplexed amplification plots of the samples containing the serially diluted positive control plasmids and the internal control are shown in FIGS. 8A and 8C. The single-plexed amplification plots of the samples containing the serially diluted positive control plasmids and the internal control are shown in FIGS. 8B and 8D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e1/e2) wild-type is −1.47, with the Ct value for samples with 1 plasmid copy/μl excluded from calculation. The average ΔCt value calculated for the detection of the internal control is −0.07.

Example 6—PCR Protocol for Multiplexed RSPO3(e1/e2) Wild-Type Positive Plasmid Control Verification and Comparison with the Single-Plexed Protocol The PCR reagent used is the same as in Example 1.

Master Mix Preparation

The master mix for the PCR reaction is prepared as set out in Table 12 (reaction volume=25 μl).

TABLE 12

| | Description | μl in each 25 μl reaction |
|---|---|---|
| Primer & Probes | PTPRK(e1) + RSPO(e2) fusion primer-probe mix (SEQ ID NO: 6, 7 and 46), | 1.00 |

TABLE 12-continued

| | Description | μl in each 25 μl reaction |
|---|---|---|
| | PTPRK(e1/e2) wild-type primer-probe mix (SEQ ID NO: 22; 23 or 24; and 47 or 48), and RSPO3(e1/e2) wild-type primer-probe mix (SEQ ID NO: 12; 13 or 14; and 49) | |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | RSPO3(e1/e2) wild-type positive control plasmid | 2.50 |
| | Total Volume | 25 |

The RT-PCR cycling conditions are the same as in Example 1.

Data Analysis

TABLE 13

| | Target | Dye/Channel | Threshold |
|---|---|---|---|
| 1 | RSPO3(e1/e2) wild-type | Cy5 | 50 RFU |
| 2 | Internal Control | HEX | 25 RFU |

Figure 9:
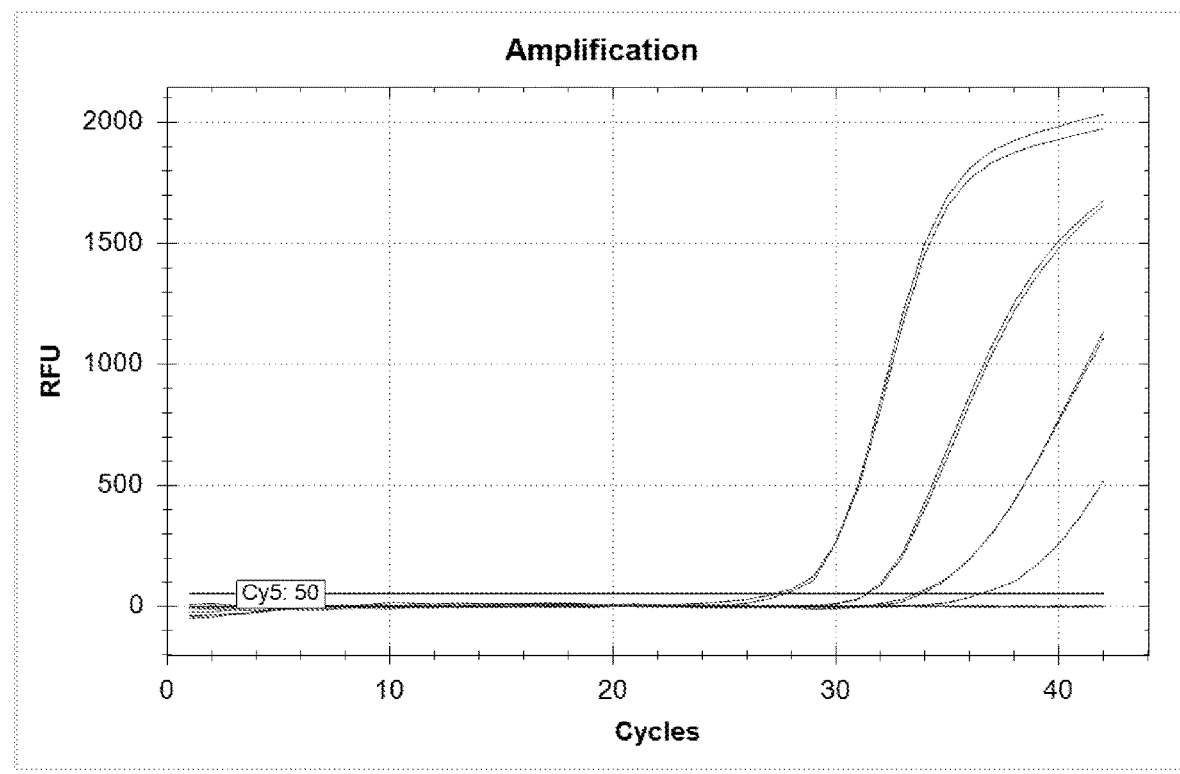
FIG. 9 shows the multiplexed amplification plots of the RSPO3(e1/e2) wild-type (A) and the internal control plasmid (C) in the samples containing the serially diluted positive control plasmids and the internal control. The single-plexed amplification plots of the RSPO3(e1/e2) wild-type (B) and the internal control plasmid (D) in the samples containing the serially diluted positive control plasmids and the internal control are also shown. The results show that in general, the multiplexed amplification reactions are more sensitive than the single-plexed reactions, as indicated by the negative $\Delta Ct$ values.
Figure 9:
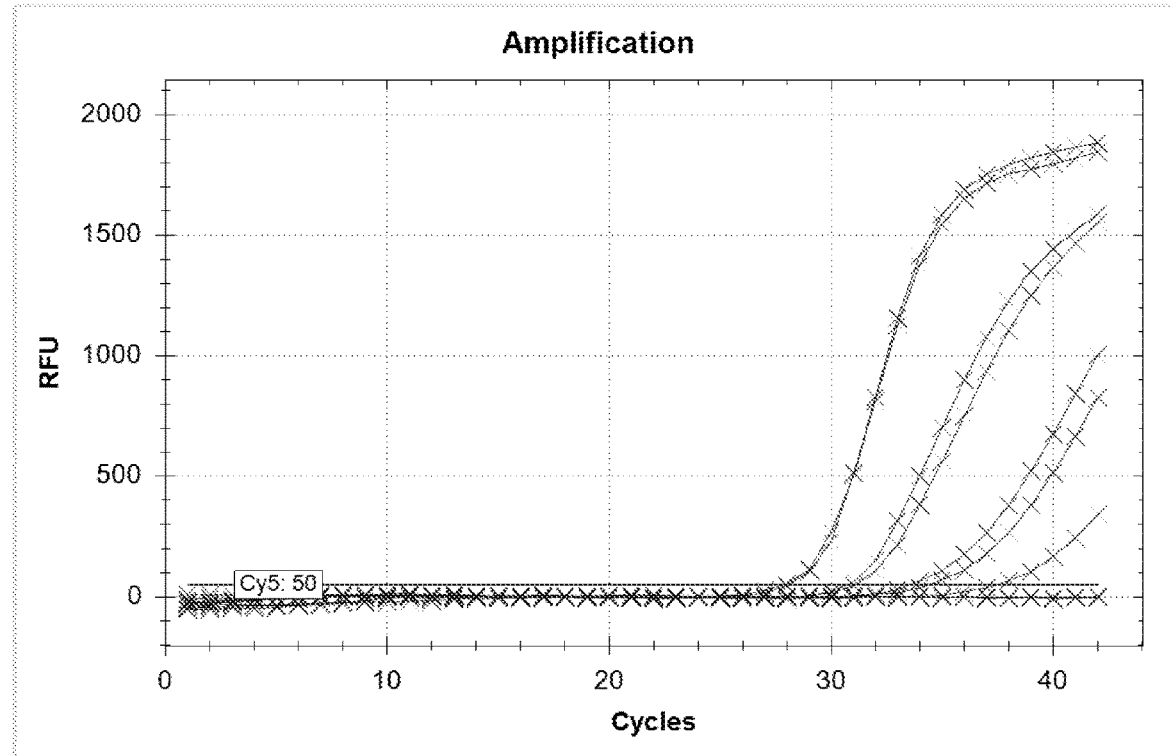
Figure 9:
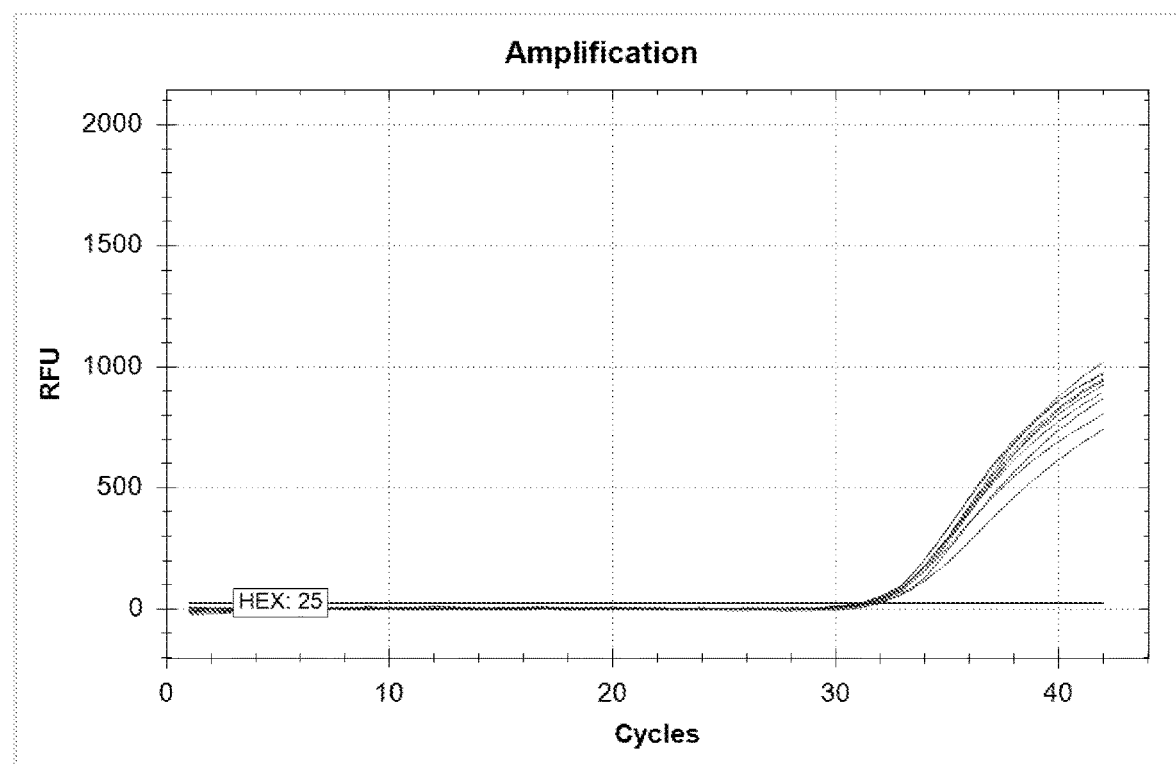
Figure 9:
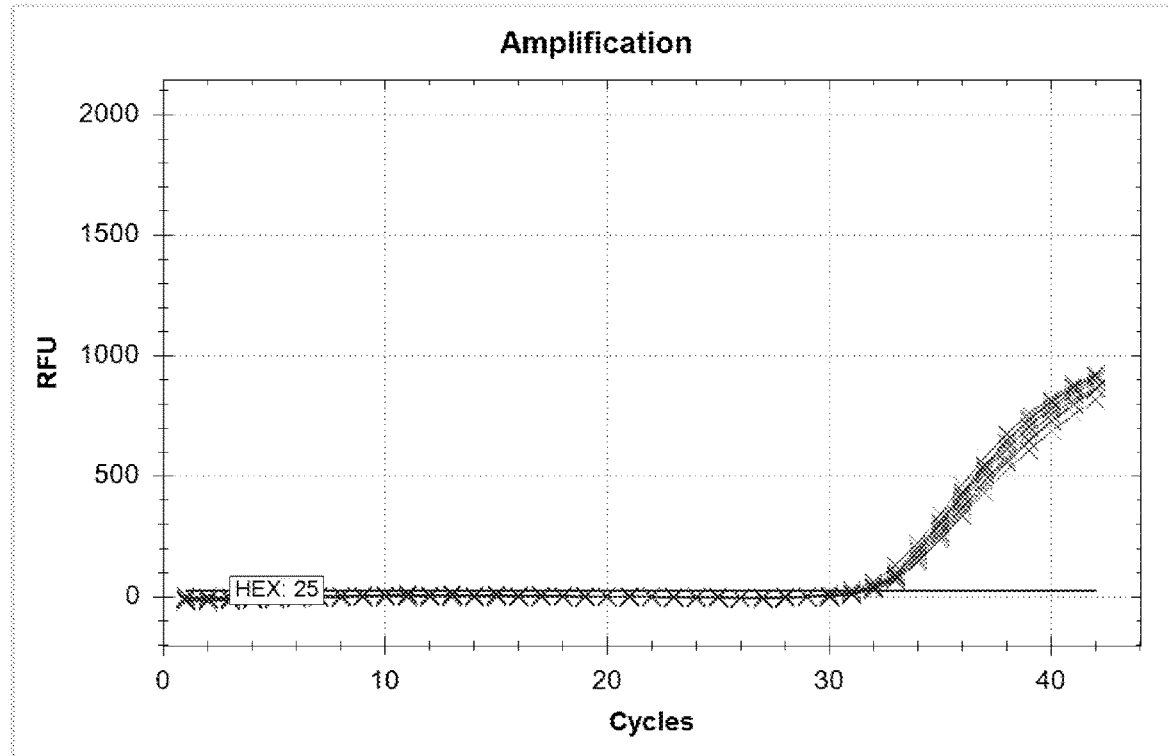

To set up the amplification curves for the RSPO3(e1/e2) wild-type, serial dilution of the positive control plasmids containing the RSPO3(e1/e2) wild-type is carried out, such that the samples for the positive control plasmids contain 1000, 100, 10 and 1 copies of the positive control plasmid respectively. The multiplexed amplification plots of the samples containing the serially diluted positive control plasmids and the internal control are shown in FIGS. 9A and 9C. The single-plexed amplification plots of the samples containing the serially diluted positive control plasmids and the internal control are shown in FIGS. 9B and 9D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the RSPO3(e1/e2) wild-type is −0.31, and the average ΔCt value calculated for the detection of the internal control is 0.20.

Example 7—PCR Protocol for Multiplexed Detection of PTPRK(e1)+RSPO3(e2) Fusion, PTPRK(e1/e2) Wild-Type and RSPO3(e1/e2) Wild-Type in Human Total RNA, and Comparison with the Single-Plexed Protocol The PCR reagent used is the same as in Example 1.

Master Mix Preparation

The master mix for the PCR reaction is prepared as set out in Table 14 (reaction volume=25 μl).

TABLE 14

| | Description | μl in each 25 μl reaction |
|---|---|---|
| Primer & Probes | PTPRK(e1) + RSPO(e2) fusion primer-probe mix (SEQ ID NO: 19, 20 and 46), | 1.00 |

TABLE 14-continued

| | Description | µl in each 25 µl reaction |
|---|---|---|
| | PTPRK(e1/e2) wild-type primer-probe mix (SEQ ID NO: 22; 23 or 24; and 47 or 48), and RSPO3(e1/e2) wild-type primer-probe mix (SEQ ID NO: 12; 13 or 14; and 49) | |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | Human total RNA | 2.50 |
| | Total Volume | 25 |

The RT-PCR cycling conditions are the same as in Example 1.
Data Analysis

TABLE 15

| | Target | Dye/Channel | Threshold |
|---|---|---|---|
| 1 | PTPRK(e1) + RSPO3(e2) fusion | FAM | 50 RFU |
| 2 | PTPRK(e1/e2) wild-type | TxRd | 50 RFU |
| 3 | RSPO3(e1/e2) wild-type | Cy5 | 50 RFU |
| 4 | Internal Control | HEX | 25 RFU |

Figure 10:
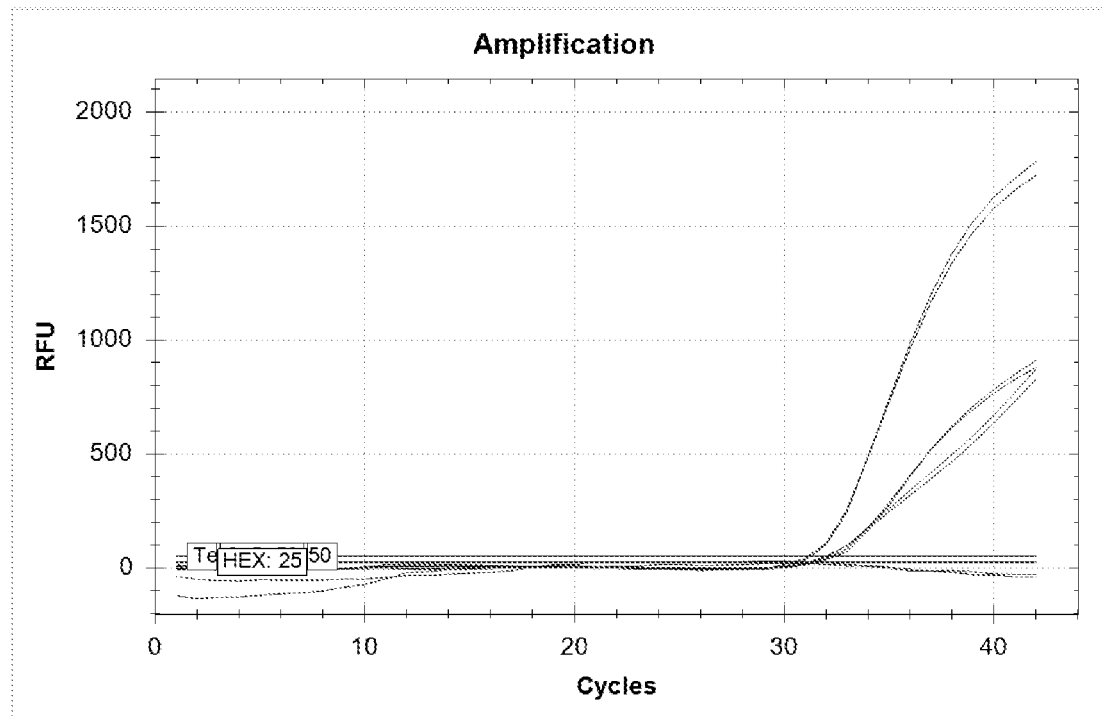
FIG. 10 shows the amplification plots of the multiplexed-detection of PTPRK(e1)+RSPO3(e2) fusion, PTPRK(e1/e2) wild-type, RSPO3(e1/e2) wild-type and the internal control in the samples containing the human total RNAs (A).
Figure 10:
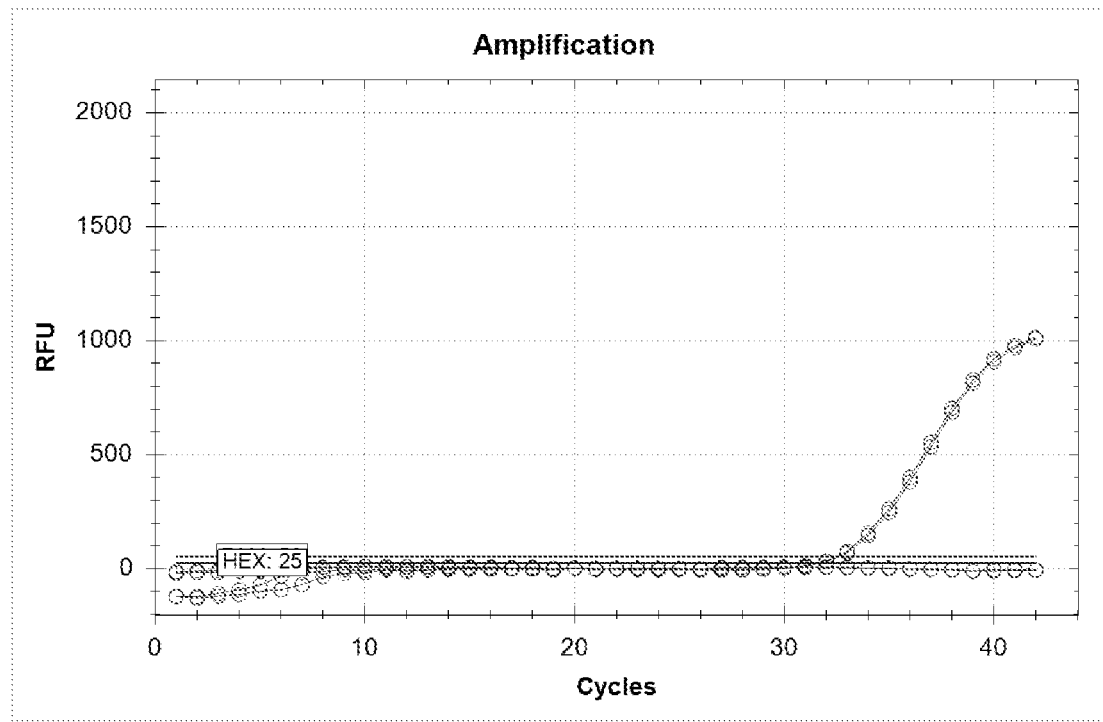
Figure 10:
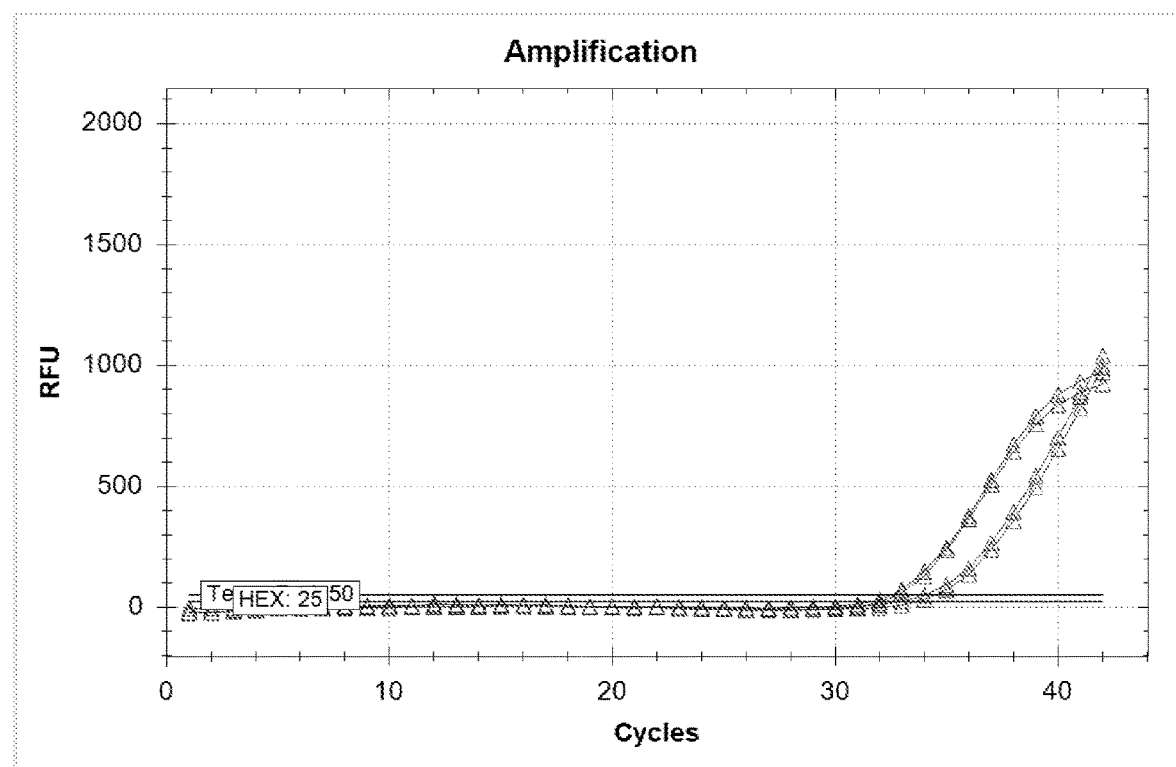
Figure 10:
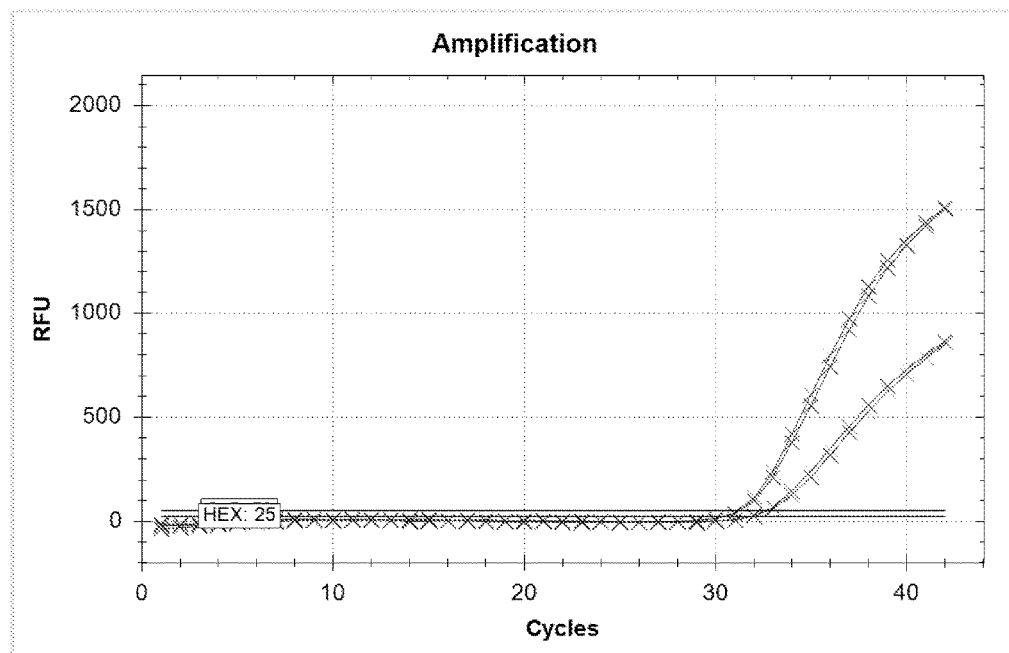

The amplification plots of the multiplexed-detection of PTPRK(e1)+RSPO3(e2) fusion, PTPRK(e1/e2) wild-type, and RSPO3(e1/e2) wild-type and the internal control in the samples containing the human total RNAs are shown in FIG. 10A. The respective amplification plots of the single-plexed reactions of PTPRK(e1)+RSPO3(e2) fusion, PTPRK(e1/e2) wild-type, and RSPO3(e1/e2) wild-type are shown in FIGS. 10B-10D. The respective Ct values are indicated below the amplification plots. The difference between the Ct value obtained using the multiplexed amplification reaction and the Ct value obtained using the single-plexed amplification reaction is denoted by ΔCt and is also included in the table.

Example 8—PCR Protocol for Multiplexed Detection of PTPRK(e1)+RSPO3(e2) Fusion, PTPRK(e1/e2) Wild-Type and RSPO3(e1/e2) Wild-Type in CR3150 Tumour RNA, and Comparison with the Single-Plexed Protocol The PCR reagent used is the same as in Example 1.
Master Mix Preparation
The master mix for the PCR reaction is prepared as set out in Table 16 (reaction volume=25 µl).

TABLE 16

| | Description | µl in each 25 µl reaction |
|---|---|---|
| Primer & Probes | PTPRK(e1) + RSPO3(e2) fusion primer-probe mix (SEQ ID NO: 19, 20 and 46), PTPRK(e1/e2) wild-type primer-probe mix (SEQ ID NO: 22; 23 or 24; and 47 or 48), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |

TABLE 16-continued

| | Description | µl in each 25 µl reaction |
|---|---|---|
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | CR3150 tumour RNA | 2.50 |
| | Total Volume | 25 |

The RT-PCR cycling conditions are the same as in Example 1.
Data Analysis

TABLE 17

| | Target | Dye/Channel | Threshold |
|---|---|---|---|
| 1 | PTPRK(e1) + RSPO3(e2) fusion | FAM | 50 RFU |
| 2 | PTPRK(e1/e2) wild-type | TxRd | 50 RFU |
| 3 | RSPO3(e1/e2) wild-type | Cy5 | 50 RFU |
| 4 | Internal Control | HEX | 25 RFU |

Figure 11:
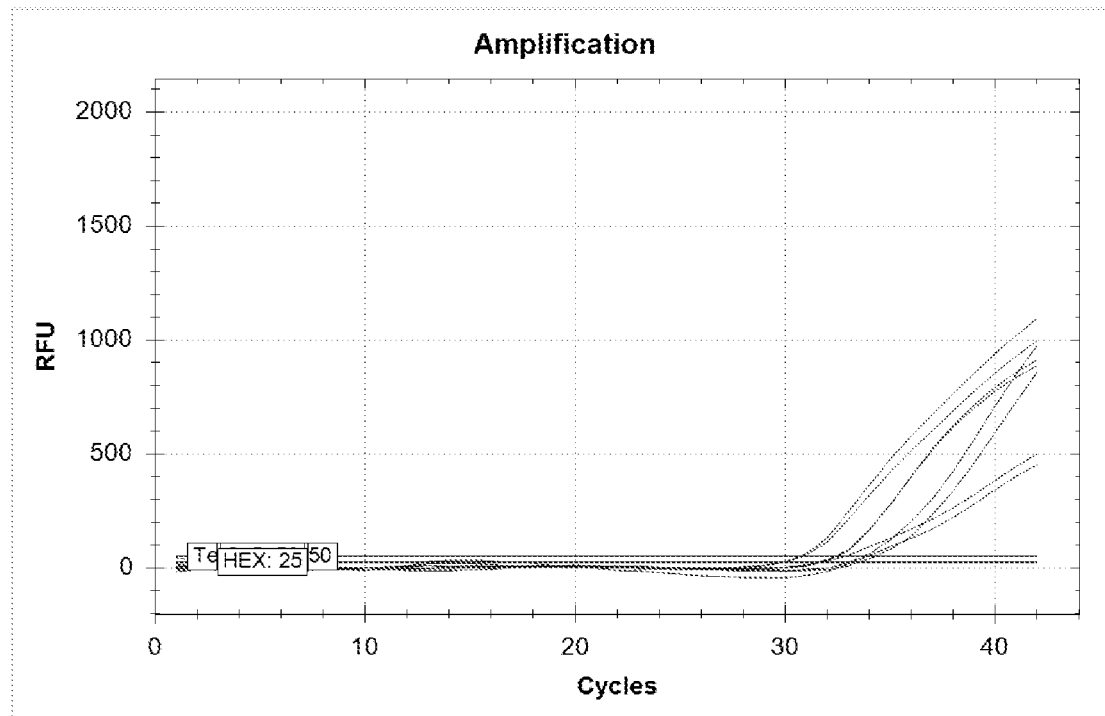
FIG. 11 shows the amplification plots of the multiplexed-detection of PTPRK(e1)+RSPO3(e2) fusion, PTPRK(e1/e2) wild-type, RSPO3(e1/e2) wild-type and the internal control in the samples containing the CR3150 tumour RNA (A). CR3150 tumour was known to contain the PTPRK(e1)+RSPO3(e2) gene-fusion.
Figure 11:
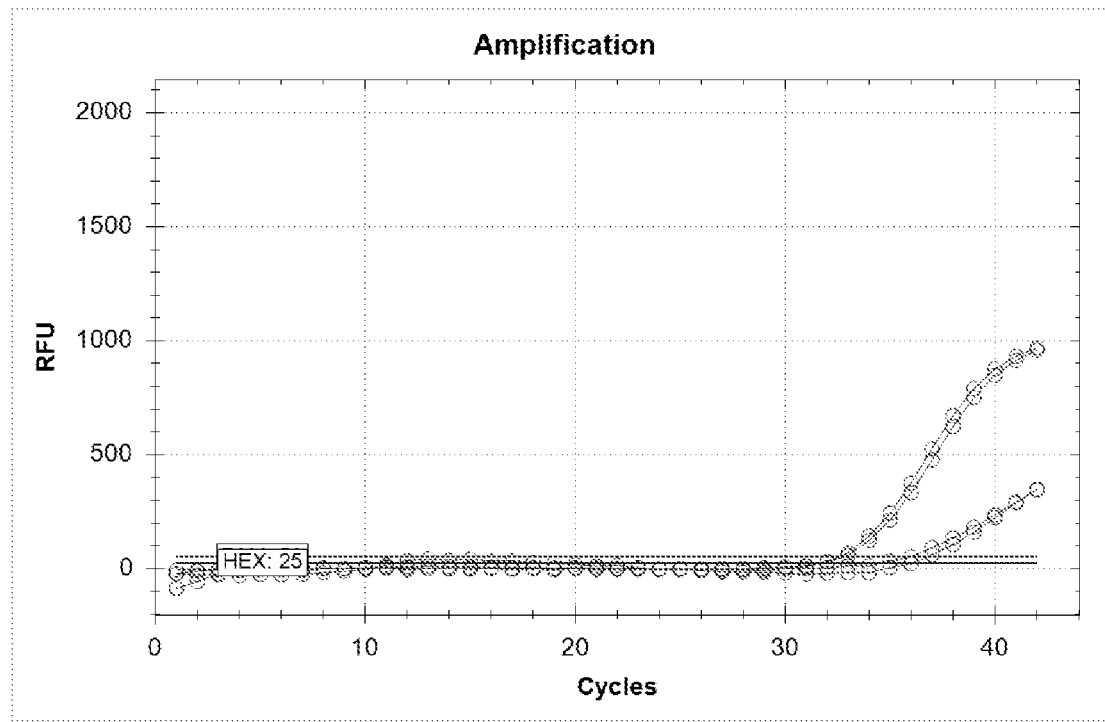
Figure 11:
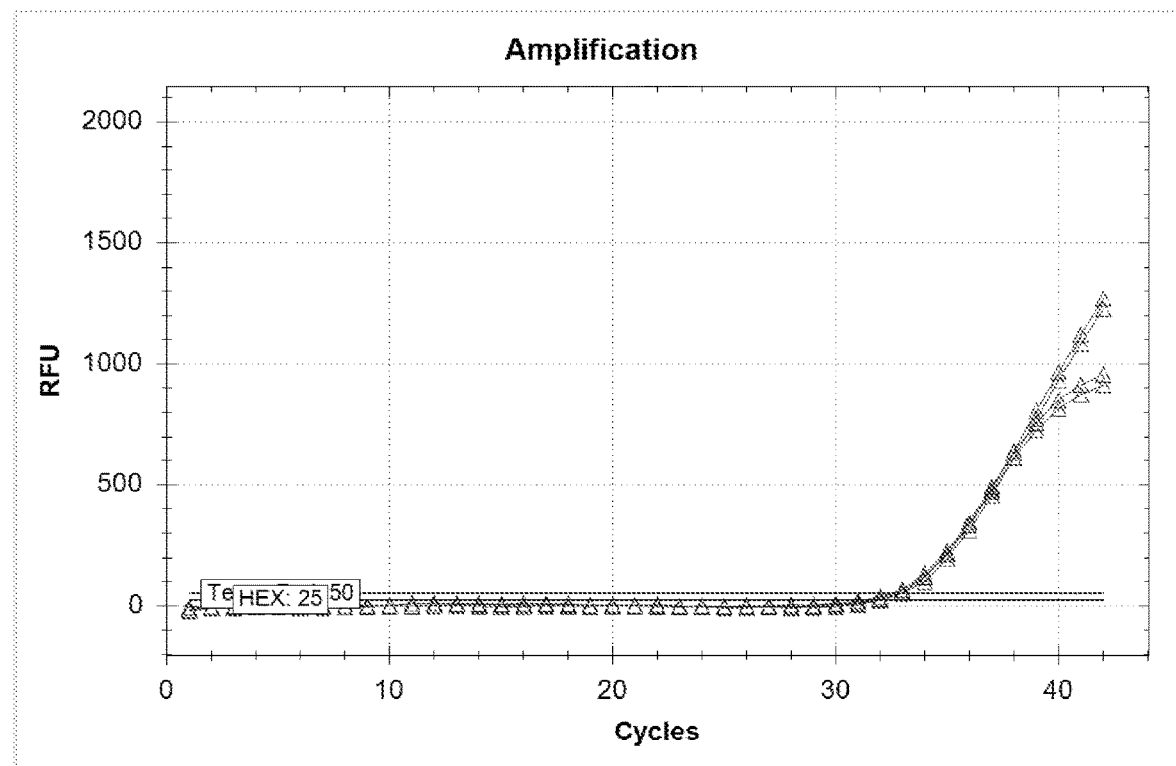
Figure 11:
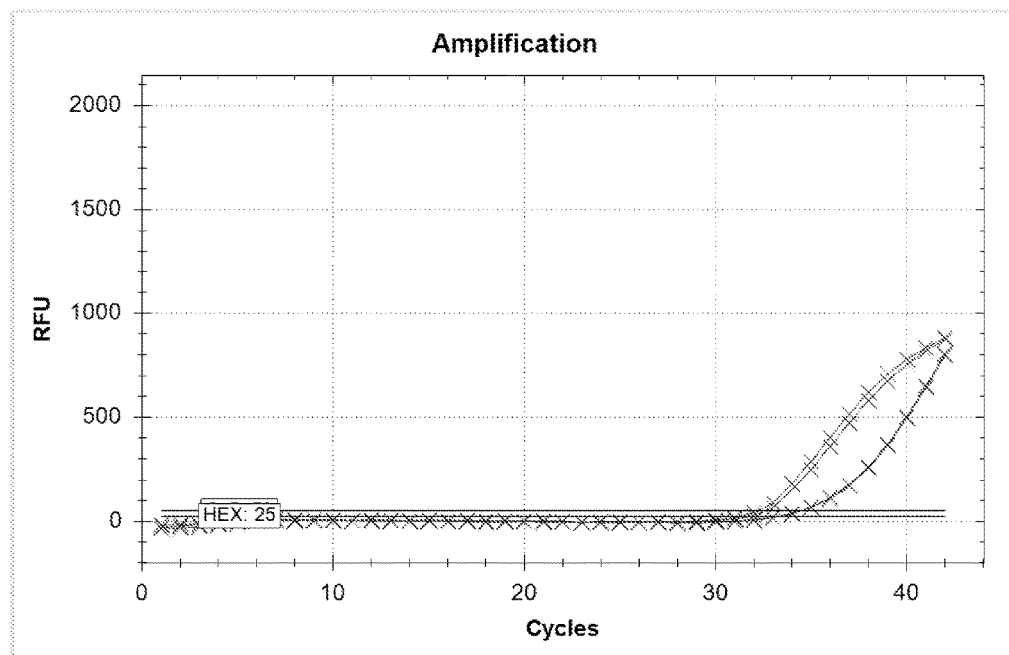

The amplification plots of the multiplexed-detection of PTPRK(e1)+RSPO3(e2) fusion, PTPRK(e1/e2) wild-type, and RSPO3(e1/e2) wild-type and the internal control in the samples containing the CR3150 tumour RNA are shown in FIG. 11A. The respective amplification plots of the single-plexed reactions of PTPRK(e1)+RSPO3(e2) fusion, PTPRK (e1/e2) wild-type, and RSPO3(e1/e2) wild-type are shown in FIGS. 11B-11D. The respective Ct values are indicated below the amplification plots. The difference between the Ct value obtained using the multiplexed amplification reaction and the Ct value obtained using the single-plexed amplification reaction is denoted by ΔCt and is also included in the table.

Example 9—PCR Protocol for Multiplexed PTPRK(e7)+RSPO3(e2) Fusion Positive Control Verification and Comparison with the Single-Plexed Protocol The PCR reagent used is the same as in Example 1.
Master Mix Preparation
The master mix for the PCR reaction is prepared as set out in Table 18 (reaction volume=25 µl).

TABLE 18

| | Description | µl in each 25 µl reaction |
|---|---|---|
| Primer & Probes | PTPRK(e7) + RSPO3(e2) fusion primer-probe mix (SEQ ID NO: 26, 27 and 51), PTPRK(e7/e8) wild-type primer-probe mix (SEQ ID NO: 29, 30 and 52), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | PTPRK(e7) + RSPO3(e2) fusion positive control plasmid | 2.50 |
| | Total Volume | 25 |

The RT-PCR cycling conditions are the same as in Example 1.

Data Analysis

TABLE 19

| | Target | Dye/Channel | Threshold |
|---|---|---|---|
| 1 | PTPRK(e7) + RSPO3(e2) fusion | FAM | 50 RFU |
| 2 | Internal Control | HEX | 25 RFU |

Figure 12:
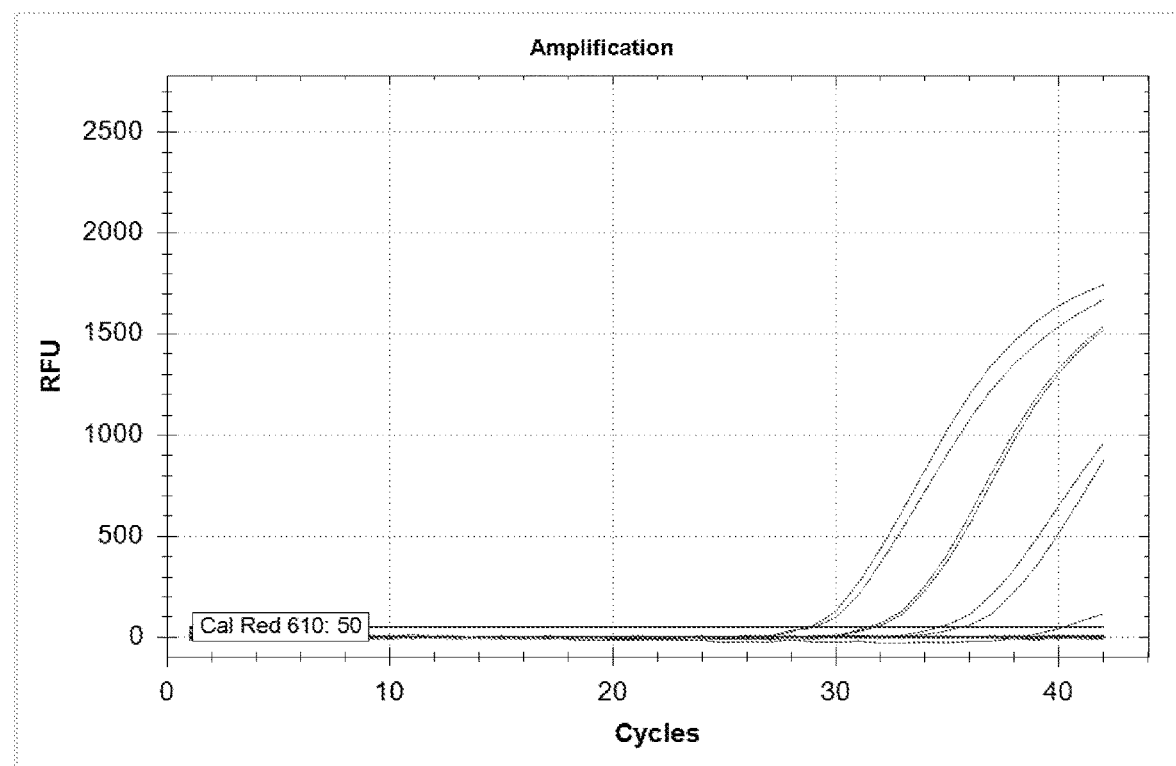
FIG. 12 shows the multiplexed amplification plots of the PTPRK(e7)+RSPO3(e2) fusion (A) and the internal control plasmid (C) in the samples containing the serially diluted positive control plasmids and the internal control. The single-plexed amplification plots of the PTPRK(e7)+RSPO3(e2) fusion (B) and the internal control plasmid (D) in the samples containing the serially diluted positive control plasmids and the internal control are also shown. The results show that in general, the multiplexed amplification reactions are more sensitive than the single-plexed reactions, as indicated by the negative ΔCt values.
Figure 12:
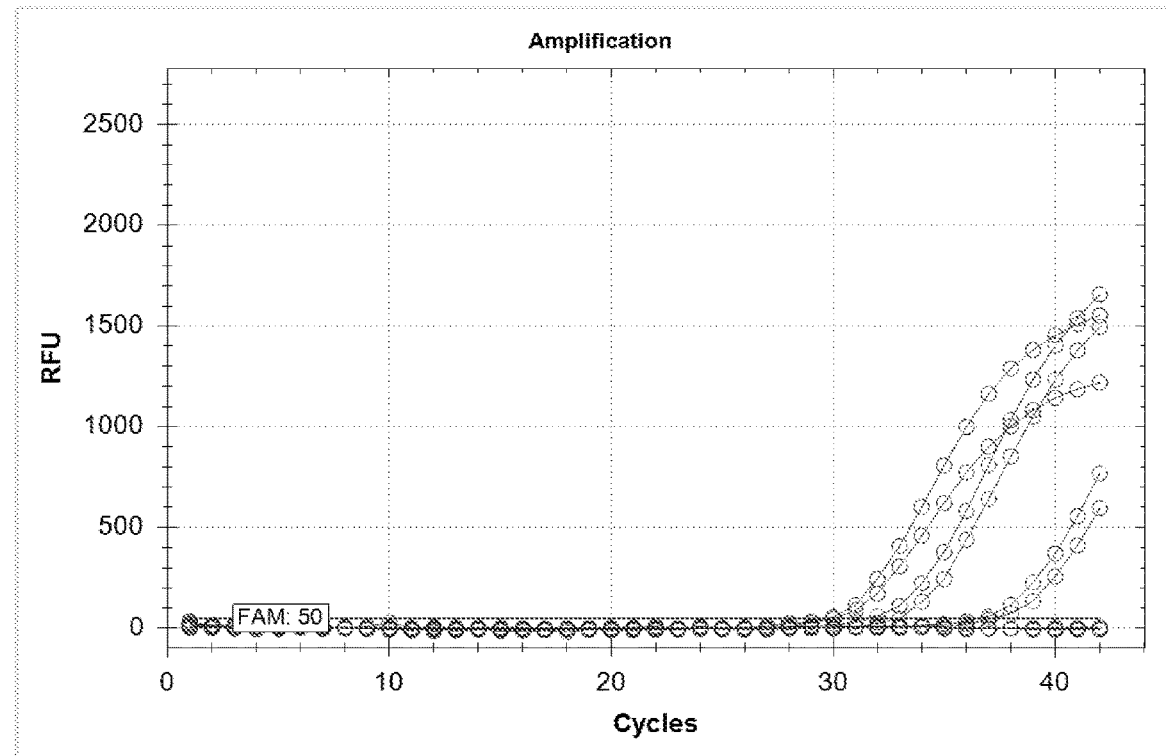
Figure 12:
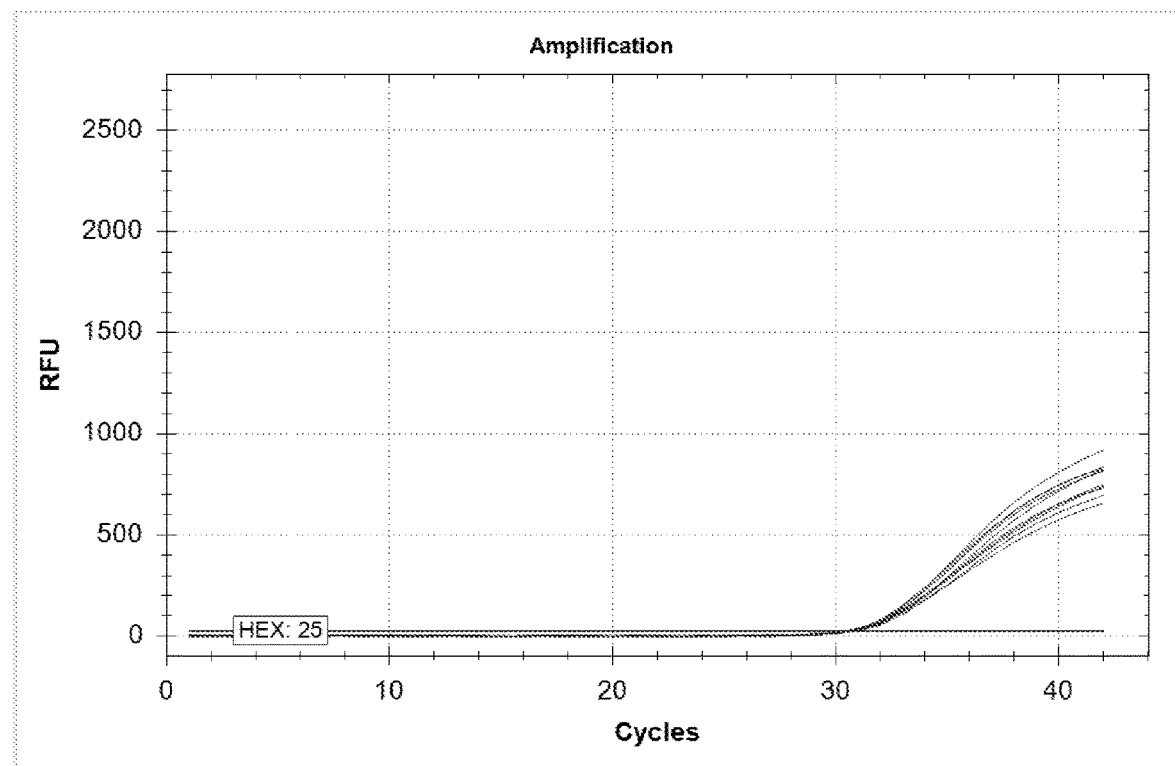
Figure 12:
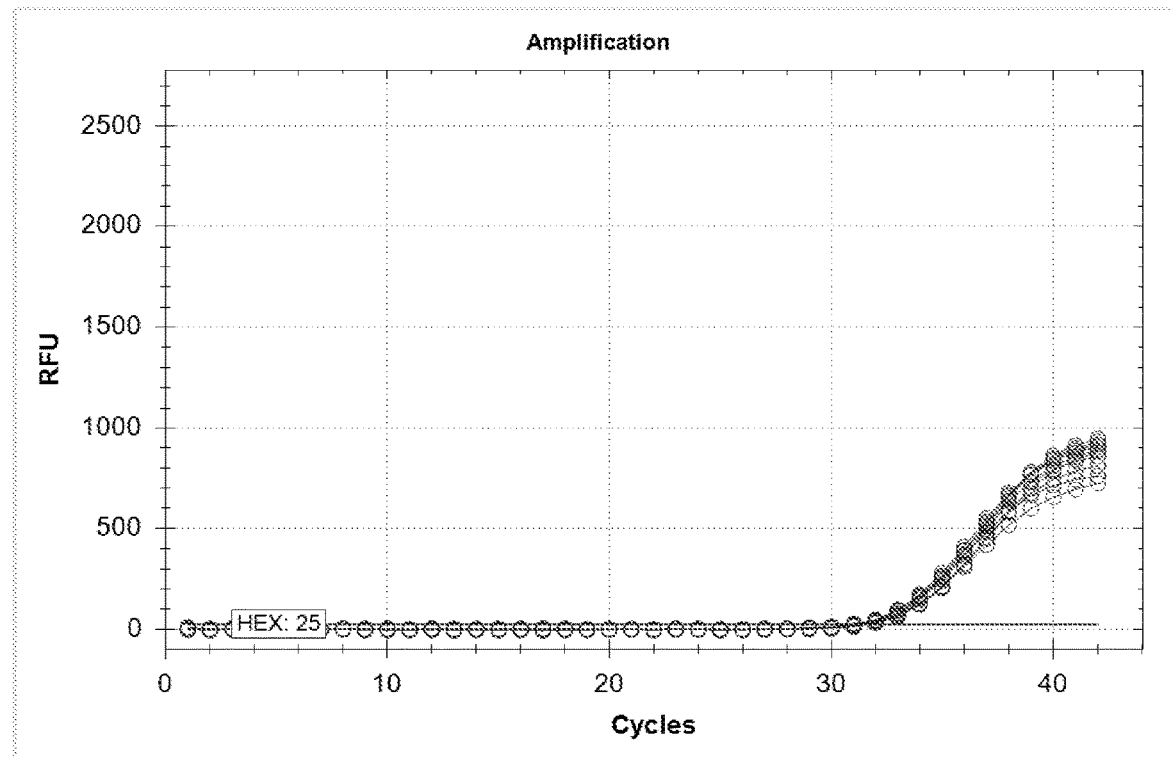

To set up the amplification curves for the PTPRK(e7)+RSPO3(e2) fusion, serial dilution of the positive control plasmids containing the PTPRK(e7)+RSPO3(e2) fusion is carried out, such that the samples for the positive control plasmids contain 1000, 100, 10 and 1 copies of the positive control plasmid respectively. 100 copies of the internal control plasmid is added in each sample. The multiplexed amplification plots of the samples containing the serially diluted positive control plasmids and the internal control are shown in FIGS. 12A and 12C. The single-plexed amplification plots of the samples containing the serially diluted positive control plasmids and the internal control are shown in FIGS. 12B and 12D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e7)+RSPO3(e2) fusion is −1.14, with the Ct value for samples with 1 plasmid copy/μl excluded from calculation. The average ΔCt value calculated for the detection of the internal control is −0.58.

Example 10—PCR Protocol for Multiplexed PTPRK(e7/e8) Wild-Type Positive Plasmid Control Verification and Comparison with the Single-Plexed Protocol The PCR reagent used is the same as in Example 1.

Master Mix Preparation

The master mix for the PCR reaction is prepared as set out in Table 20 (reaction volume=25 μl).

TABLE 20

| | Description | μl in each 25 μl reaction |
|---|---|---|
| Primer & Probes | PTPRK(e7) + RSPO3(e2) fusion primer-probe mix (SEQ ID NO: 26, 27 and 51), PTPRK(e7/e8) wild-type primer-probe mix (SEQ ID NO: 29, 30 and 52), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | PTPRK(e7/e8) wild-type positive control plasmid | 2.50 |
| | Total Volume | 25 |

The RT-PCR cycling conditions are the same as in Example 1.

Data Analysis

TABLE 21

| | Target | Dye/Channel | Threshold |
|---|---|---|---|
| 1 | PTPRK(e7/e8) wild-type | Cal Red 610 | 50 RFU |
| 2 | Internal Control | HEX | 25 RFU |

Figure 13:
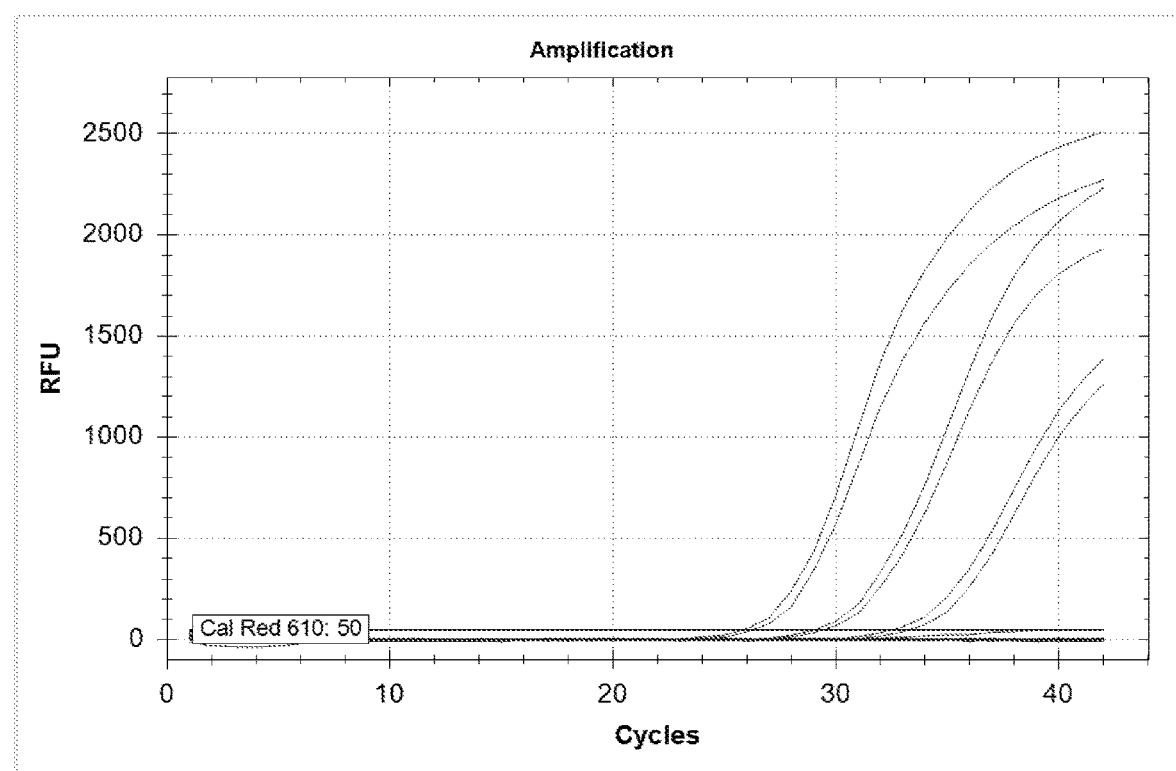
FIG. 13 shows the multiplexed amplification plots of the PTPRK(e7/e8) wild-type (A) and the internal control plasmid (C) in the samples containing the serially diluted positive control plasmids and the internal control. The single-plexed amplification plots of the PTPRK(e7/e8) wild-type (B) and the internal control plasmid (D) in the samples containing the serially diluted positive control plasmids and the internal control are also shown. The results show that in general, the multiplexed amplification reactions are more sensitive than the single-plexed reactions, as indicated by the negative ΔCt values.
Figure 13:
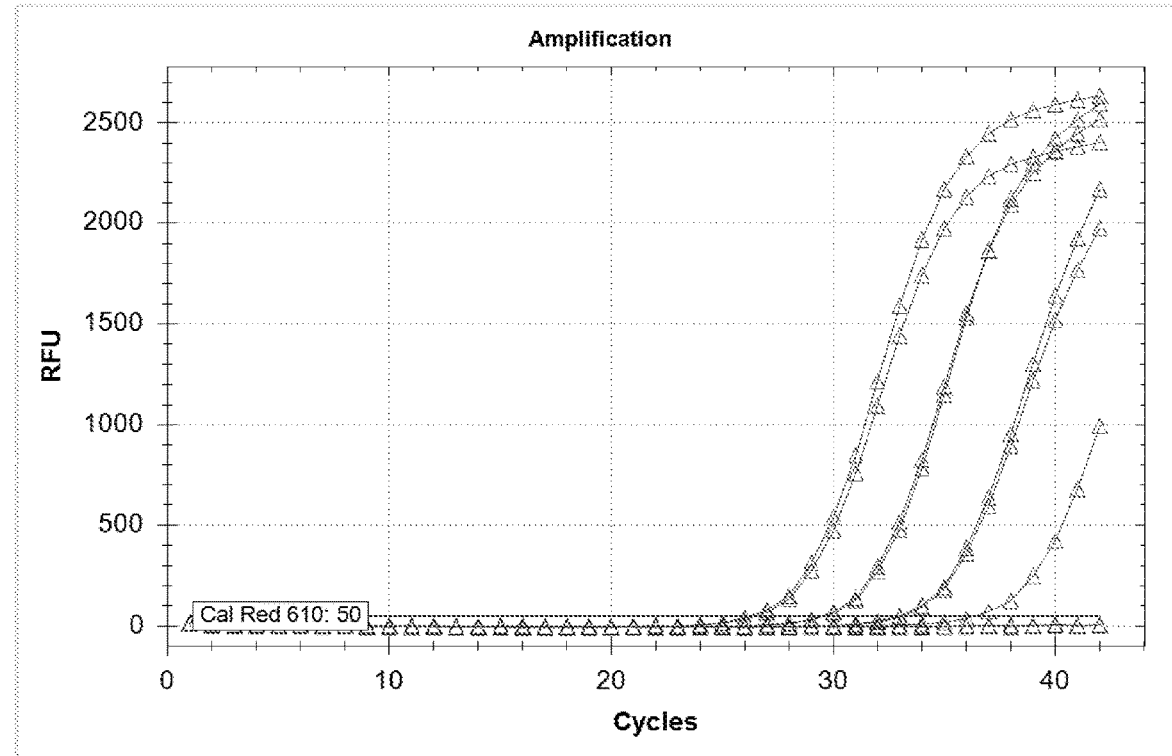
Figure 13:
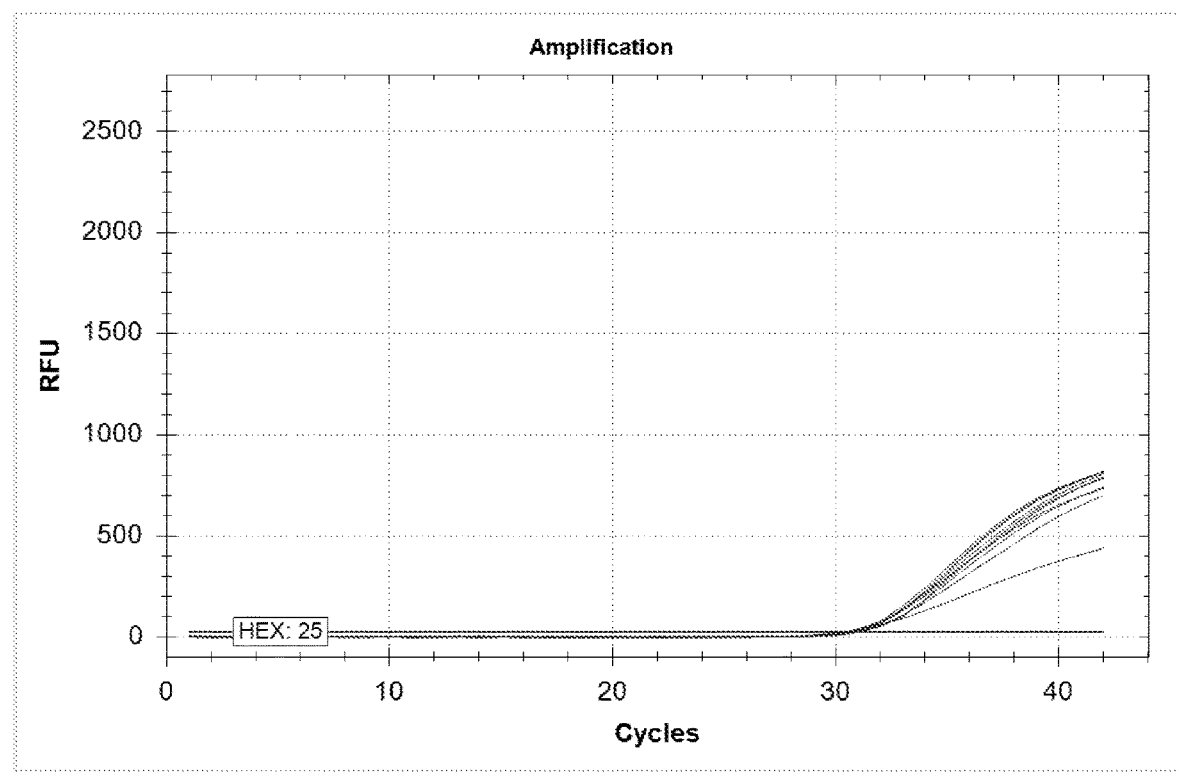
Figure 13:
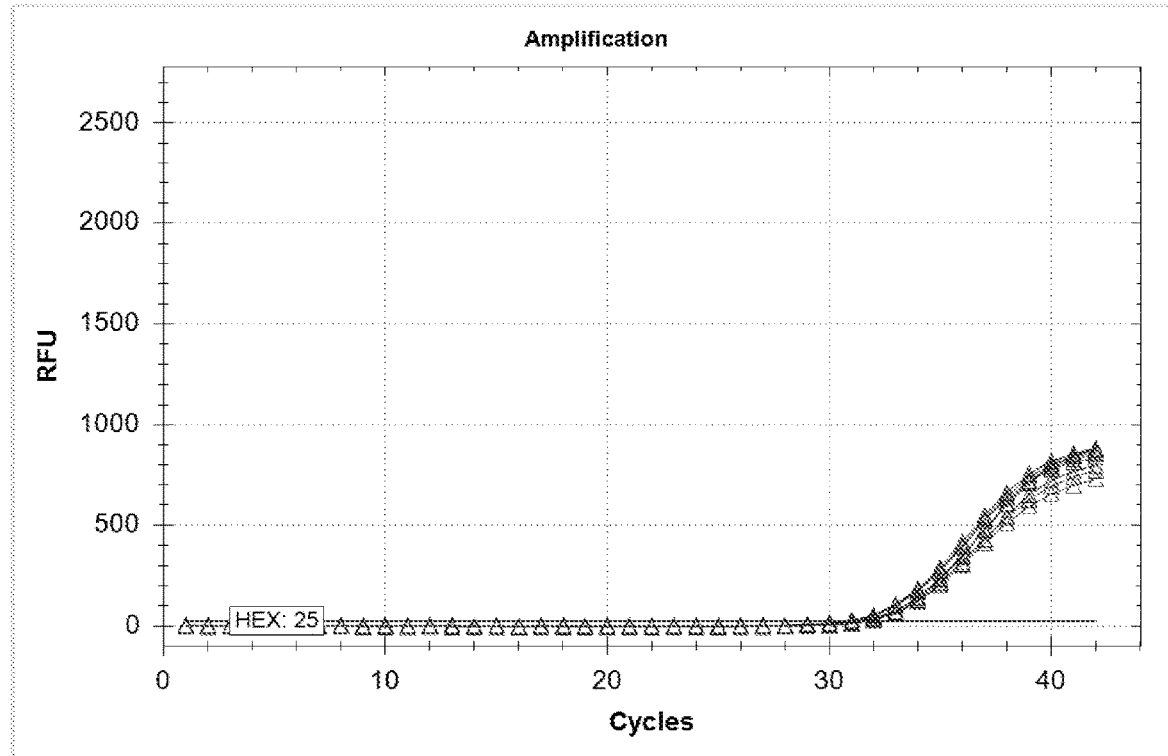

To set up the amplification curves for the PTPRK(e7/e8) wild-type, serial dilution of the positive control plasmids containing the PTPRK(e7/e8) wild-type is carried out, such that the samples for the positive control plasmids contain 1000, 100, 10 and 1 copies of the positive control plasmid respectively. 100 copies of the internal control plasmid is added in each sample. The multiplexed amplification plots of the samples containing the serially diluted positive control plasmids and the internal control are shown in FIGS. 13A and 13C. The single-plexed amplification plots of the samples containing the serially diluted positive control plasmids and the internal control are shown in FIGS. 13B and 13D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e7/e8) wild-type is −0.23, with the Ct value for samples with 1 plasmid copy/μl excluded from calculation. The average ΔCt value calculated for the detection of the internal control is −0.55.

Example 11—PCR Protocol for Multiplexed RSPO3(e1/e2) Wild-Type Positive Plasmid Control Verification and Comparison with the Single-Plexed Protocol The PCR reagent used is the same as in Example 1.

Master Mix Preparation

The master mix for the PCR reaction is prepared as set out in Table 22 (reaction volume=25 μl).

TABLE 22

| | Description | μl in each 25 μl reaction |
|---|---|---|
| Primer & Probes | PTPRK(e7) + RSPO3(e2) fusion primer-probe mix (SEQ ID NO: 26, 27 and 51), PTPRK(e7/e8) wild-type primer-probe mix (SEQ ID NO: 29, 30 and 52), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | RSPO3(e1/e2) wild-type positive control plasmid | 2.50 |
| | Total Volume | 25 |

The RT-PCR cycling conditions are the same as in Example 1.

Data Analysis

TABLE 23

|   | Target | Dye/Channel | Threshold |
|---|---|---|---|
| 1 | RSPO3(e1/e2) wild-type | Cy5 | 50 RFU |
| 2 | Internal Control | HEX | 25 RFU |

Figure 14:
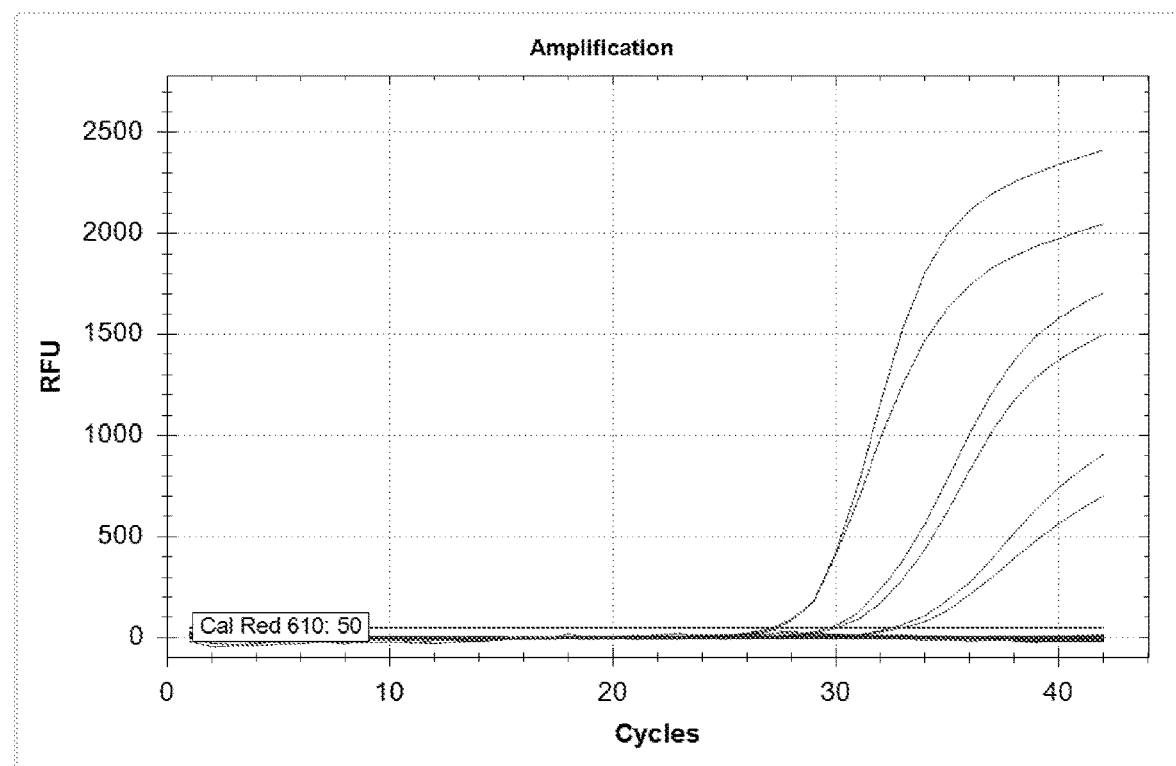
FIG. 14 shows the multiplexed amplification plots of the RSPO3(e1/e2) wild-type (A) and the internal control plasmid (C) in the samples containing the serially diluted positive control plasmids and the internal control. The single-plexed amplification plots of the RSPO3(e1/e2) wild-type (B) and the internal control plasmid (D) in the samples containing the serially diluted positive control plasmids and the internal control are also shown. The results show that in general, the multiplexed amplification reactions are more sensitive than the single-plexed reactions, as indicated by the negative ΔCt values.
Figure 14:
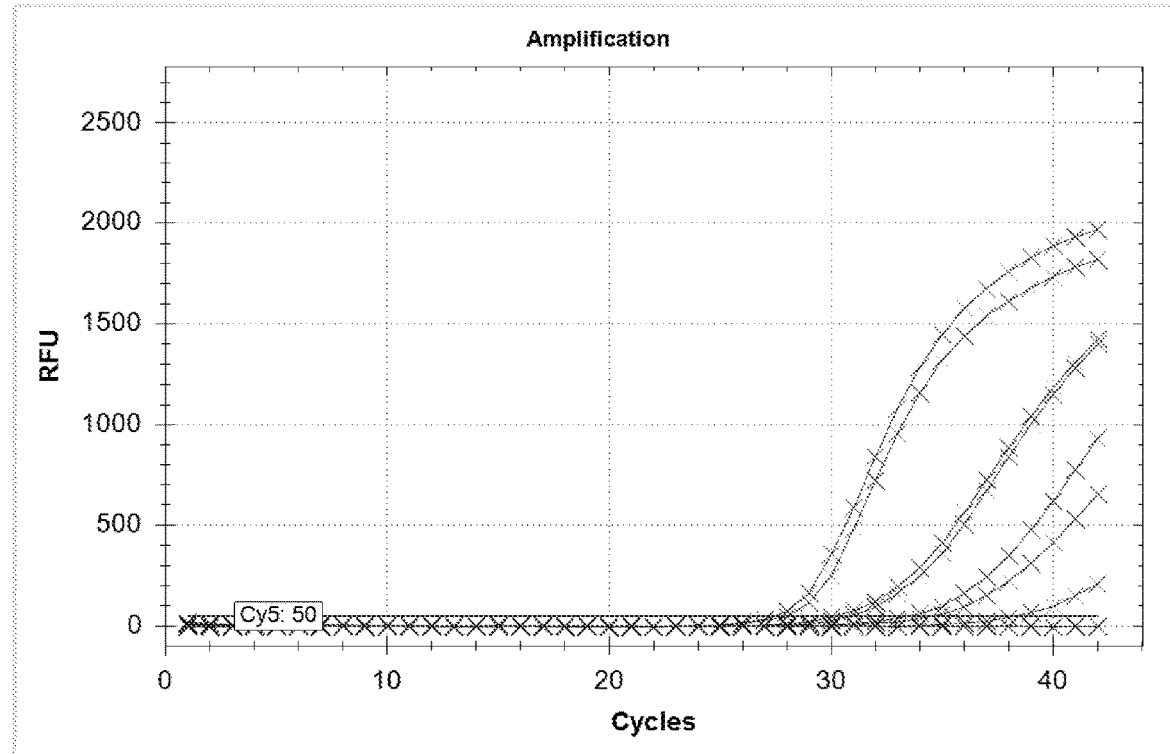
Figure 14:
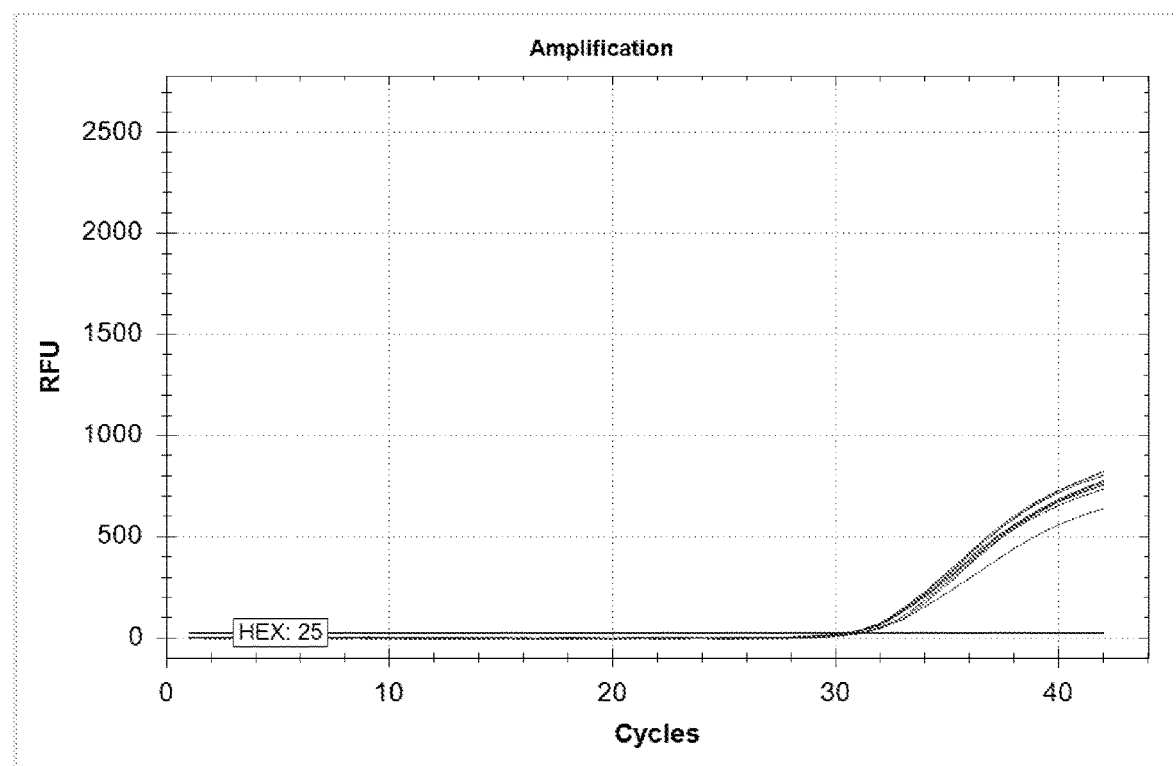
Figure 14:
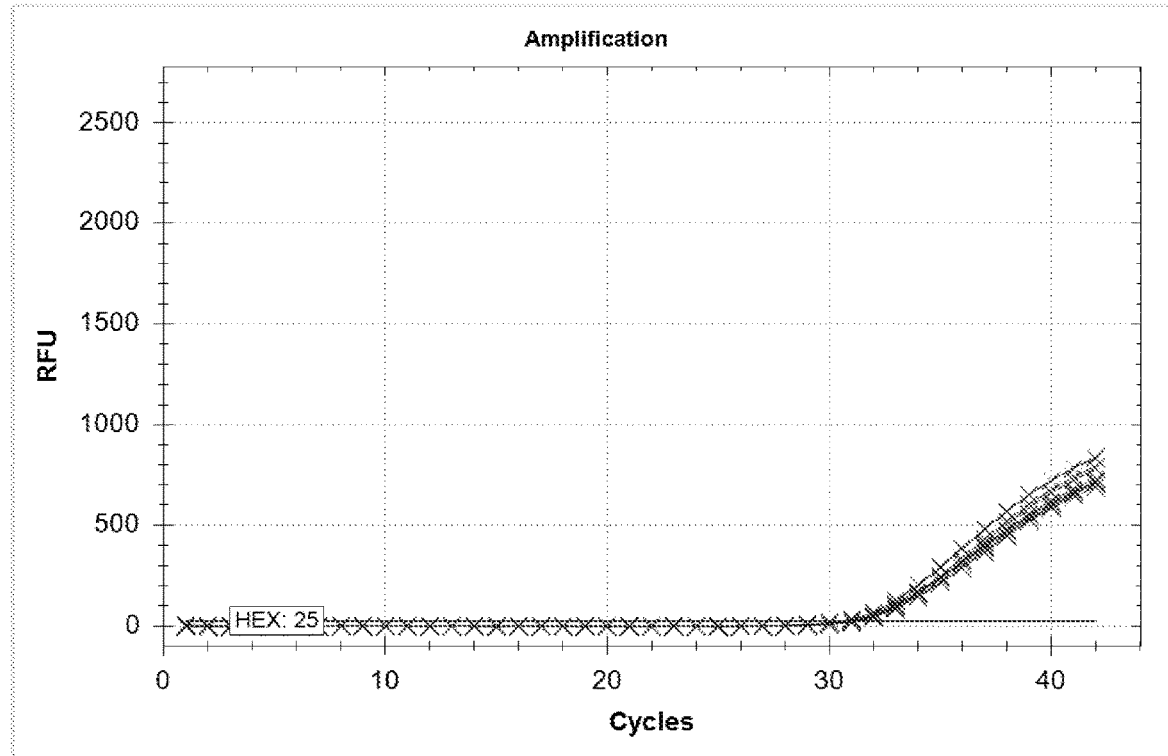

To set up the amplification curves for the RSPO3(e1/e2) wild-type, serial dilution of the positive control plasmids containing the RSPO3(e1/e2) wild-type is carried out, such that the samples for the positive control plasmids contain 1000, 100, 10 and 1 copies of the positive control plasmid respectively. 100 copies of the internal control plasmid is added in each sample. The multiplexed amplification plots of the samples containing the serially diluted positive control plasmids and the internal control are shown in FIGS. 14A and 14C. The single-plexed amplification plots of the samples containing the serially diluted positive control plasmids and the internal control are shown in FIGS. 14B and 14D. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the RSPO3(e1/e2) wild-type is −0.73, with the Ct value for samples with 1 plasmid copy/μl excluded from calculation. The average ΔCt value calculated for the detection of the internal control is −0.18.

Example 12—PCR Protocol for Multiplexed Detection of PTPRK(e7)+RSPO3(e2) Fusion, PTPRK(e7/e8) Wild-Type and RSPO3(e1/e2) Wild-Type in Human Total RNA, and Comparison with the Single-Plexed Protocol The PCR reagent used is the same as in Example 1.

Master Mix Preparation

The master mix for the PCR reaction is prepared as set out in Table 24 (reaction volume=25 μl).

TABLE 24

|   | Description | μl in each 25 μl reaction |
|---|---|---|
| Primer & Probes | PTPRK(e7) + RSPO3(e2) fusion primer-probe mix (SEQ ID NO: 26, 27 and 51), PTPRK(e7/e8) wild-type primer-probe mix (SEQ ID NO: 29, 30 and 52), and RSPO3(e1/e2) wild-type primer-probe mix (SEQ ID NO: 12; 13 or 14; and 49) | 1.00 |
|   | Internal control primer-probe mix (SEQ ID NO: 16, 17 and 50) | 1.00 |
| Reagents | SuperScriptIII RT/Plt Taq mix (50x) | 0.50 |
|   | Reaction mix (2x) | 12.50 |
|   | Internal control template | 0.10 |
|   | Nuclease-free water | 7.40 |
| Test sample | Human total RNA | 2.50 |
|   | Total Volume | 25 |

The RT-PCR cycling conditions are the same as in Example 1.

Data Analysis

TABLE 25

|   | Target | Dye/Channel | Threshold |
|---|---|---|---|
| 1 | PTPRK(e7) + RSPO3(e2) fusion | FAM | 50 RFU |
| 2 | PTPRK(e7/e8) wild-type | Cal Red 610 | 50 RFU |
| 3 | RSPO3(e1/e2) wild-type | Cy5 | 50 RFU |
| 4 | Internal Control | HEX | 25 RFU |

Figure 15:
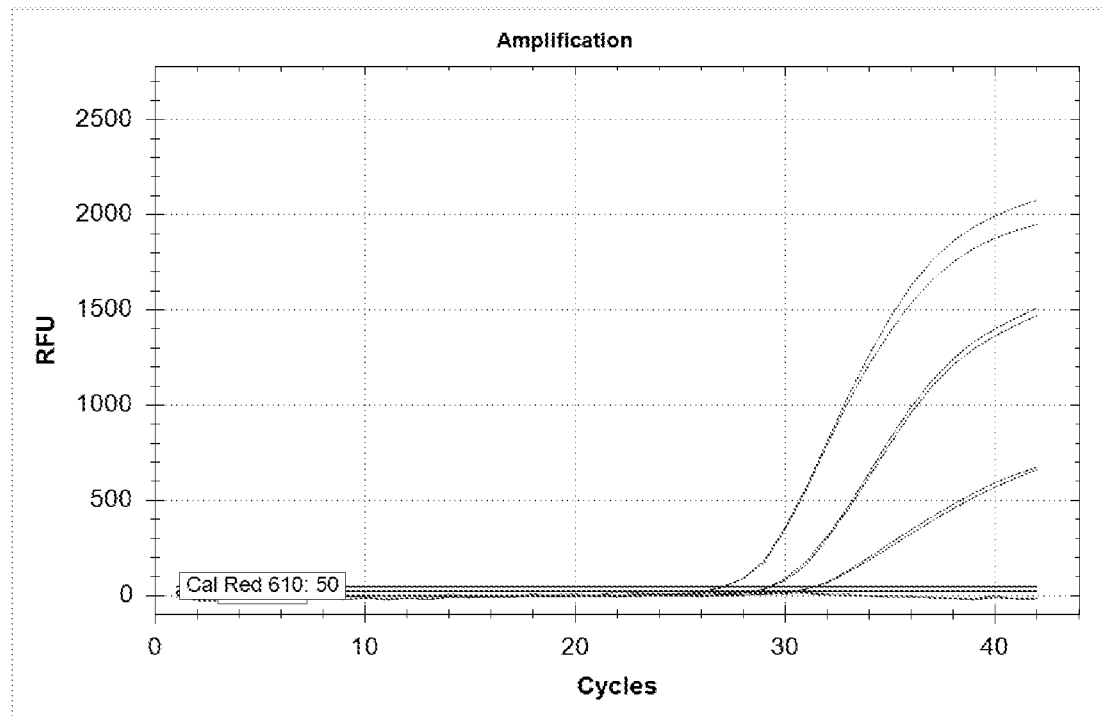
FIG. 15 shows the amplification plots of the multiplexed-detection of PTPRK(e7)+RSPO3(e2) fusion, PTPRK(e7/e8) wild-type, RSPO3(e1/e2) wild-type and the internal control in the samples containing the human total RNAs (A).
Figure 15:
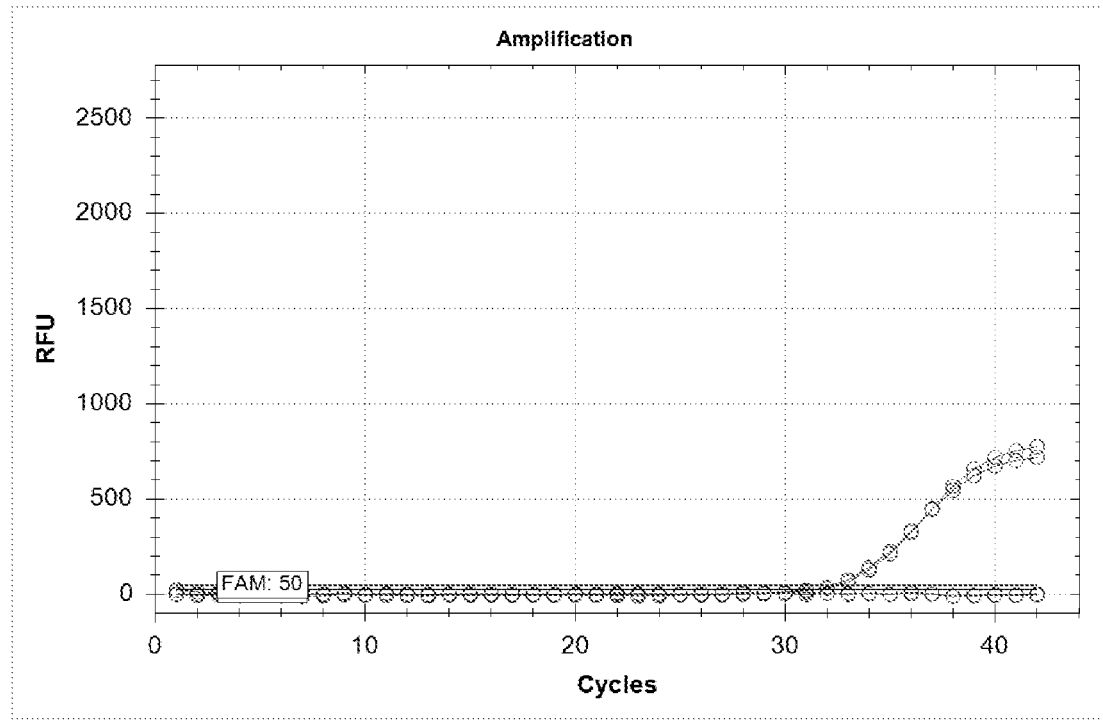
Figure 15:
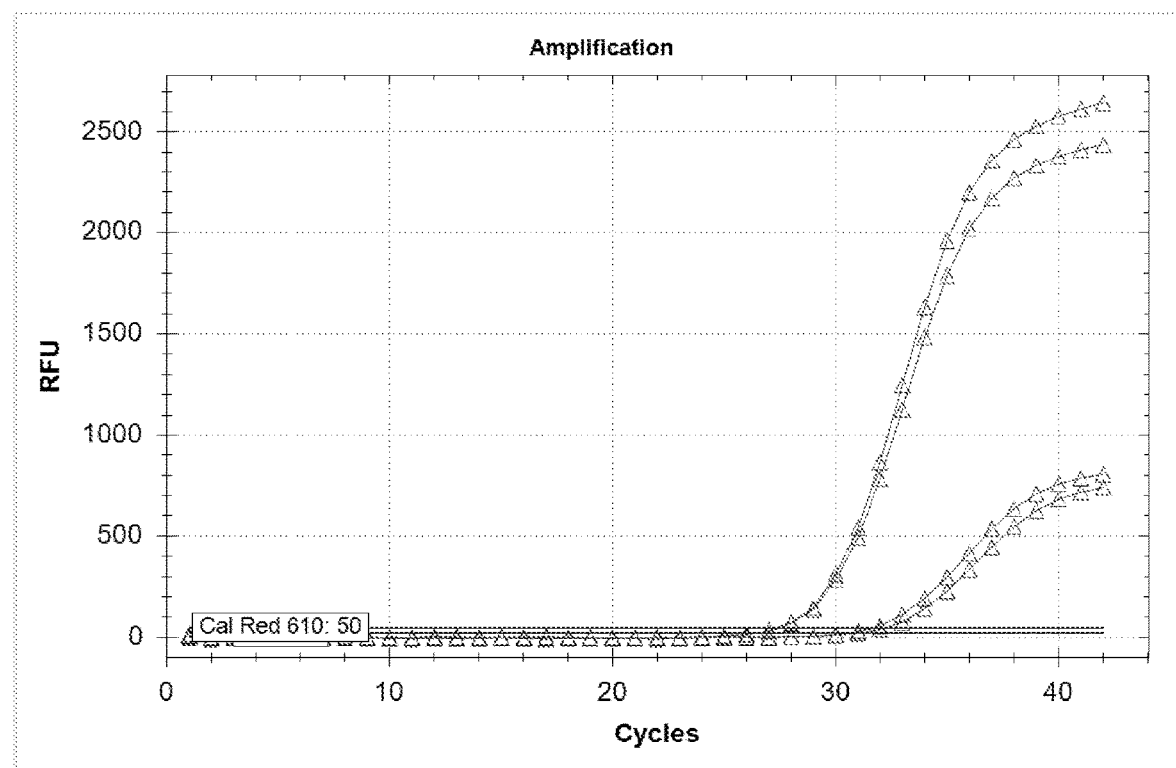
Figure 15:
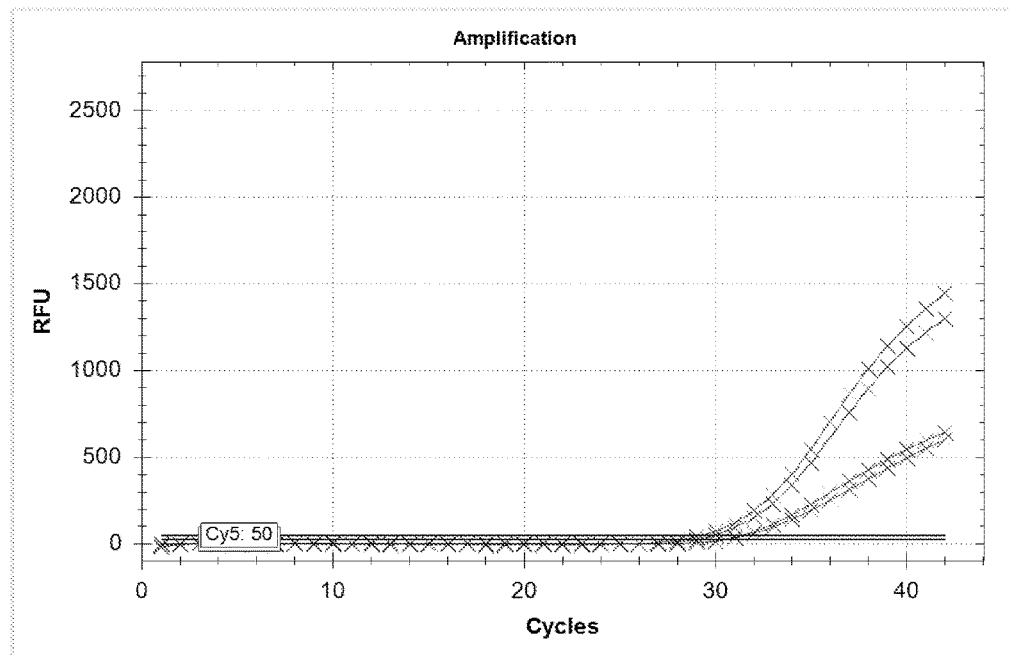

The amplification plots of the multiplexed-detection of PTPRK(e7)+RSPO3(e2) fusion, PTPRK(e7/e8) wild-type, and RSPO3(e1/e2) wild-type and the internal control in the samples containing the human total RNAs are shown in FIG. 15A. The respective amplification plots of the single-plexed reactions of PTPRK(e7)+RSPO3(e2) fusion, PTPRK(e7/e8) wild-type, and RSPO3(e1/e2) wild-type are shown in FIGS. 15B-15D. The respective Ct values are indicated below the amplification plots. The difference between the Ct value obtained using the multiplexed amplification reaction and the Ct value obtained using the single-plexed amplification reaction is denoted by ΔCt and is also included in the table.

Example 13—PCR Protocol for Multiplexed PTPRK(e13)+RSPO3(e2) Fusion Positive Control Verification and Comparison with the Single-Plexed Protocol The PCR reagent used is the same as in Example 1.

Master Mix Preparation

The master mix for the PCR reaction is prepared as set out in Table 26 (reaction volume=25 μl).

TABLE 26

|   | Description | μl in each 25 μl reaction |
|---|---|---|
| Primer & Probes | PTPRK(e13) + RSPO3(e2) fusion primer-probe mix (SEQ ID NO: 6, 7 and 53 or 54), PTPRK(e12-e14) wild-type primer-probe mix (SEQ ID NO: 9, 10 and 55), and RSPO3(e1/e2) wild-type primer-probe mix (SEQ ID NO: 12; 13 or 14; and 49) | 1.00 |
|   | Internal control primer-probe mix (SEQ ID NO: 16, 17 and 50) | 1.00 |
| Reagents | SuperScriptIII RT/Plt Taq mix (50x) | 0.50 |
|   | Reaction mix (2x) | 12.50 |
|   | Internal control template | 0.10 |
|   | Nuclease-free water | 7.40 |
| Test sample | PTPRK(e13) + RSPO3(e2) fusion positive control plasmid | 2.50 |
|   | Total Volume | 25 |

The RT-PCR cycling conditions are the same as in Example 1.

Data Analysis

TABLE 27

|   | Target | Dye/Channel | Threshold |
|---|---|---|---|
| 1 | PTPRK(e13) + RSPO3(e2) fusion | FAM | 50 RFU |
| 2 | Internal Control | HEX | 25 RFU |

To set up the amplification curves for the PTPRK(e13)+RSPO3(e2) fusion, serial dilution of the positive control plasmids containing the PTPRK(e13)+RSPO3(e2) fusion is carried out, such that the samples for the positive control plasmids contain 1000, 100, 10 and 1 copies of the positive control plasmid respectively. 100 copies of the internal control plasmid is added in each sample. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e13)+RSPO3(e2) fusion is −0.33, with the Ct value for samples with 1 plasmid copy/μl excluded from calculation. The average ΔCt value calculated for the detection of the internal control is 0.01.

Example 14—PCR Protocol for Multiplexed PTPRK(e12-e14) Wild-Type Positive Plasmid Control Verification and Comparison with the Single-Plexed Protocol The PCR reagent used is the same as in Example 1.
Master Mix Preparation
The master mix for the PCR reaction is prepared as set out in Table 28 (reaction volume=25 μl).

TABLE 28

| | Description | μl in each 25 μl reaction |
|---|---|---|
| Primer & Probes | PTPRK(e13) + RSPO3(e2) fusion primer-probe mix (SEQ ID NO: 6, 7 and 53 or 54), PTPRK(e12-e14) wild-type primer-probe mix (SEQ ID NO: 9, 10 and 55), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | PTPRK(e12-e14) wild-type positive control plasmid | 2.50 |
| | Total Volume | 25 |

The RT-PCR cycling conditions are the same as in Example 1.
Data Analysis

TABLE 29

| | Target | Dye/Channel | Threshold |
|---|---|---|---|
| 1 | PTPRK(e12-e14) wild-type | TxRd | 50 RFU |
| 2 | Internal Control | HEX | 25 RFU |

To set up the amplification curves for the PTPRK(e12-e14) wild-type, serial dilution of the positive control plasmids containing the PTPRK(e12-e14) wild-type is carried out, such that the samples for the positive control plasmids contain 1000, 100, 10 and 1 copies of the positive control plasmid respectively. 100 copies of the internal control plasmid is added in each sample. The respective Ct values are indicated below the amplification plot. The difference between the Ct value obtained using the multiplexed amplification reaction and the Ct value obtained using the single-plexed amplification reaction is denoted by ΔCt and is also included in the table. The average ΔCt value calculated for the detection of the PTPRK(e12-e14) wild-type is 0.25. The average ΔCt value calculated for the detection of the internal control is 0.07.

Example 15—PCR Protocol for Multiplexed Detection of PTPRK(e13)+RSPO3(e2) Fusion and PTPRK(e12-e14) Wild-Type in Human Total RNA, and Comparison with the Single-Plexed Protocol The PCR reagent used is the same as in Example 1.
Master Mix Preparation
The master mix for the PCR reaction is prepared as set out in Table 30 (reaction volume=25 μl).

TABLE 30

| | Description | μl in each 25 μl reaction |
|---|---|---|
| Primer & Probes | PTPRK(e13) + RSPO3(e2) fusion primer-probe mix (SEQ ID NO: 6, 7 and 53 or 54), PTPRK(e12-e14) wild-type primer-probe mix (SEQ ID NO: 9, 10 and 55), and RSPO3(e1/e2) wild-type primer-probe mix (SEQ ID NO: 12; 13 or 14; and 49) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | Human total RNAs | 2.50 |
| | Total Volume | 25 |

The RT-PCR cycling conditions are the same as in Example 1.
Data Analysis

TABLE 31

| | Target | Dye/Channel | Threshold |
|---|---|---|---|
| 1 | PTPRK(e13) + RSPO3(e2) fusion | FAM | 50 RFU |
| 2 | PTPRK(e12-e14) wild-type | TxRd | 50 RFU |
| 3 | Internal Control | HEX | 25 RFU |

The difference between the Ct value obtained using the multiplexed amplification reaction and the Ct value obtained using the single-plexed amplification reaction is denoted by ΔCt and is also included in the table.

Example 16—PCR Protocol for Multiplexed Detection of PTPRK(e13)+RSPO3(e2) Fusion and PTPRK(e12-e14) Wild-Type in CR2506 Tumour RNA, and Comparison with the Single-Plexed Protocol The PCR reagent used is the same as in Example 1.
Master Mix Preparation
The master mix for the PCR reaction is prepared as set out in Table 32 (reaction volume=25 μl).

TABLE 32

| | Description | μl in each 25 μl reaction |
|---|---|---|
| Primer & Probes | PTPRK(e13) + RSPO3(e2) fusion primer-probe mix (SEQ ID NO: 6, 7 and 53 or 54), PTPRK(e12-e14) wild-type primer-probe mix (SEQ ID NO: 9, 10 and 55), and RSPO3(e1/e2) wild-type primer-probe mix (SEQ ID NO: 12; 13 or 14; and 49) | 1.00 |

TABLE 32-continued

|  | Description | μl in each 25 μl reaction |
|---|---|---|
| Reagents | Internal control primer-probe mix (SEQ ID NO: 16, 17 and 50) | 1.00 |
|  | SuperScriptIII RT/Plt Taq mix (50x) | 0.50 |
|  | Reaction mix (2x) | 12.50 |
|  | Internal control template | 0.10 |
|  | Nuclease-free water | 7.40 |
| Test sample | CR2506 tumour RNA | 2.50 |
|  | Total Volume | 25 |

The RT-PCR cycling conditions are the same as in Example 1.

Data Analysis

TABLE 33

|  | Target | Dye/Channel | Threshold |
|---|---|---|---|
| 1 | PTPRK(e13) + RSPO3(e2) fusion | FAM | 50 RFU |
| 2 | PTPRK(e12-e14) wild-type | TxRd | 50 RFU |
| 3 | Internal Control | HEX | 25 RFU |

The respective Ct values are indicated below the amplification plots. The difference between the Ct value obtained using the multiplexed amplification reaction and the Ct value obtained using the single-plexed amplification reaction is denoted by ΔCt and is also included in the table.

Example 17—PCR Protocol for Single-Plexed EIF3E(e1)+RSPO2(e2) Fusion Positive Control Verification The PCR reagent used is the same as in Example 1.

Master Mix Preparation

The master mix for the PCR reaction is prepared as set out in Table 34 (reaction volume=25 μl).

TABLE 34

|  | Description | μl in each 25 μl reaction |
|---|---|---|
| Primer & Probes | EIF3E(e1) + RSPO2(e2) fusion primer-probe mix (SEQ ID NO: 35 or 36; 37 and 56) | 1.00 |
|  | Internal control primer-probe mix (SEQ ID NO: 16, 17 and 50) | 1.00 |
| Reagents | SuperScriptIII RT/Plt Taq mix (50x) | 0.50 |
|  | Reaction mix (2x) | 12.50 |
|  | Internal control template | 0.10 |
|  | Nuclease-free water | 7.40 |
| Test sample | EIF3E(e1) + RSPO2(e2) fusion positive control plasmid | 2.50 |
|  | Total Volume | 25 |

The RT-PCR cycling conditions are the same as in Example 1.

Data Analysis

TABLE 35

|  | Target | Dye/Channel | Threshold |
|---|---|---|---|
| 1 | EIF3E(e1) + RSPO2(e2) fusion | FAM | 50 RFU |
| 2 | Internal Control | HEX | 25 RFU |

Figure 16:
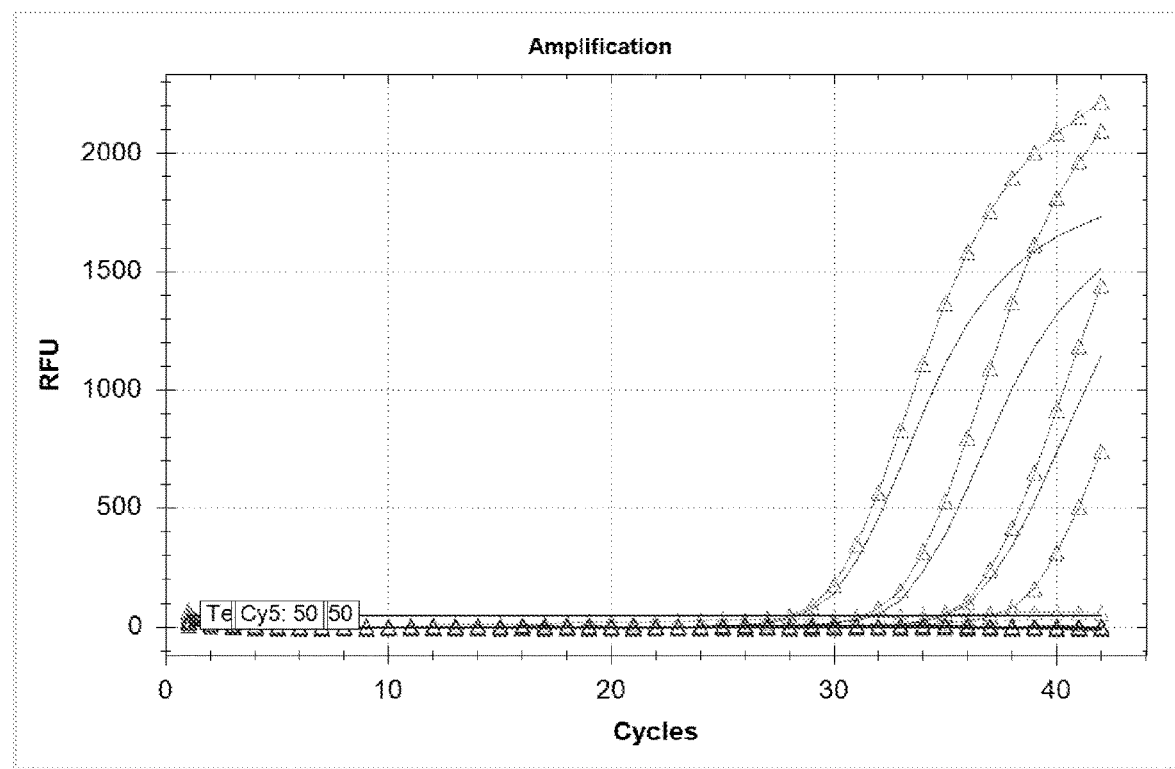
FIG. 16 shows the amplification plots of EIF3E(e1)+RSPO2(e2) fusion (A) and the internal control (B). Each sample contains 100 copies of the internal control plasmids and 1000, 100, 10 or 1 copies of the positive control plasmid respectively. The results show that the PCR amplification reactions designed can successfully amplify the EIF3E(e1)+RSPO2(e2) fusion positive control plasmids and the internal control plasmids.
Figure 16:
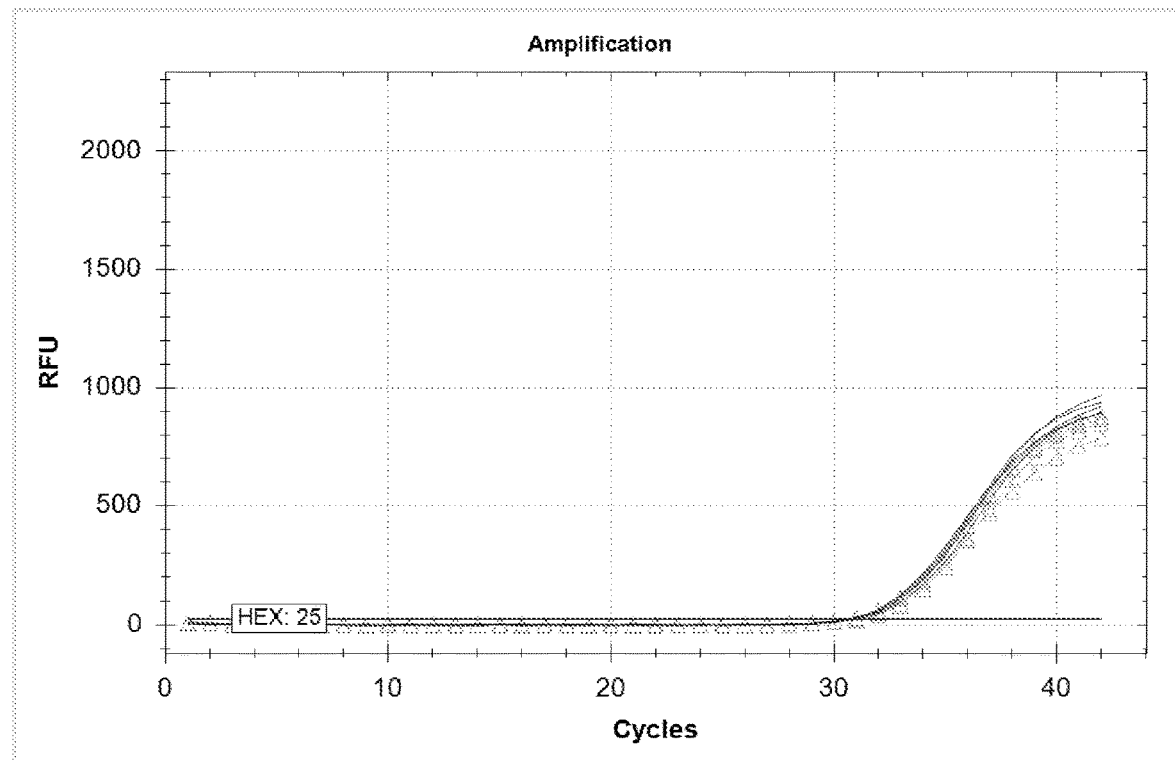

To set up the amplification curves for the EIF3E(e1)+RSPO2(e2) fusion, serial dilution of the positive control plasmids containing the EIF3E(e1)+RSPO2(e2) fusion is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmids and internal control are shown in FIGS. 16A and 16B, with the respective Ct values indicated below each amplification plot.

Example 18—PCR Protocol for Single-Plexed EIF3E(e1/e2) Wild-Type Positive Plasmid Control Verification The PCR reagent used is the same as in Example 1.

Master Mix Preparation

The master mix for the PCR reaction is prepared as set out in Table 36 (reaction volume=25 μl).

TABLE 36

|  | Description | μl in each 25 μl reaction |
|---|---|---|
| Primer & Probes | EIF3E(e1/e2) wild-type primer-probe mix (SEQ ID NO: 39, 40 and 57) | 1.00 |
|  | Internal control primer-probe mix (SEQ ID NO: 16, 17 and 50) | 1.00 |
| Reagents | SuperScriptIII RT/Plt Taq mix (50x) | 0.50 |
|  | Reaction mix (2x) | 12.50 |
|  | Internal control template | 0.10 |
|  | Nuclease-free water | 7.40 |
| Test sample | EIF3E(e1/e2) wild-type positive control plasmid | 2.50 |
|  | Total Volume | 25 |

The RT-PCR cycling conditions are the same as in Example 1.

Data Analysis

TABLE 37

|  | Target | Dye/Channel | Threshold |
|---|---|---|---|
| 1 | EIF3E(e1/e2) wild-type | TxRd | 50 RFU |
| 2 | Internal Control | HEX | 25 RFU |

Figure 17:
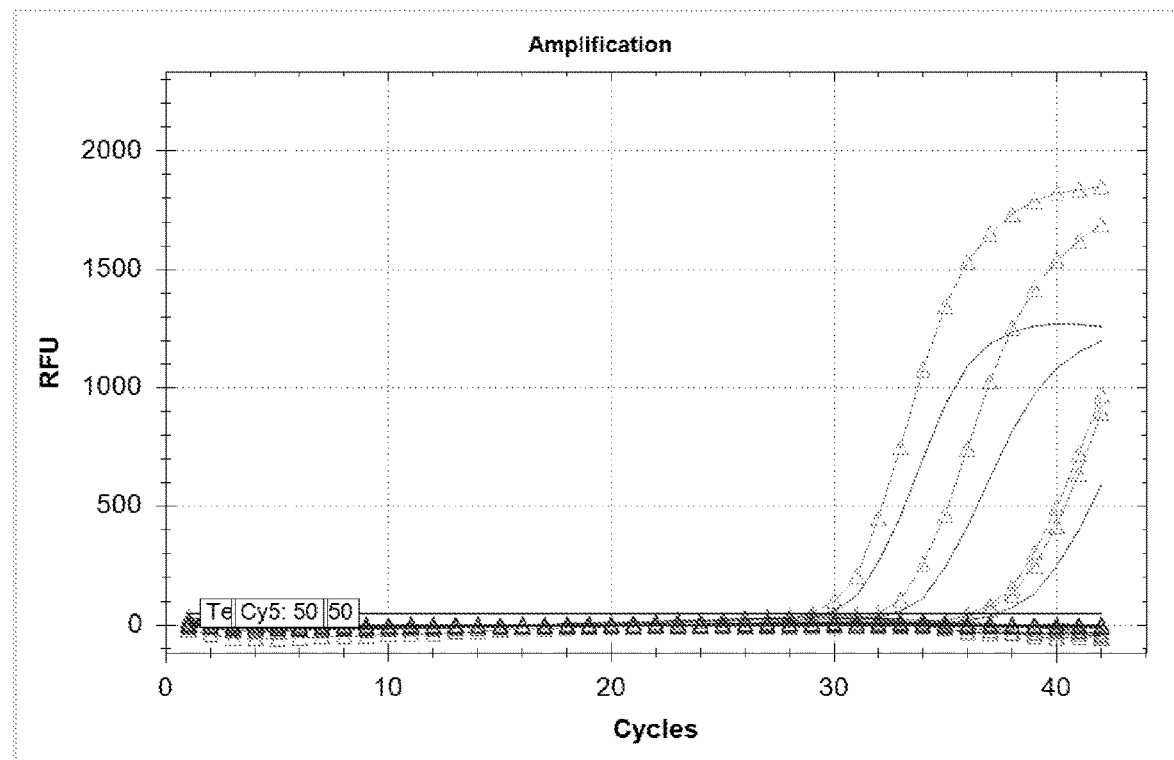
FIG. 17 shows the amplification plots of EIF3E(e1/e2) wild-type (A) and the internal control (B). Each sample contains 100 copies of the internal control plasmids and 1000, 100, 10 or 1 copies of the positive control plasmid respectively. The results show that the PCR amplification reactions designed can successfully amplify the EIF3E(e1/e2) wild-type positive control plasmids and the internal control plasmids.
Figure 17:
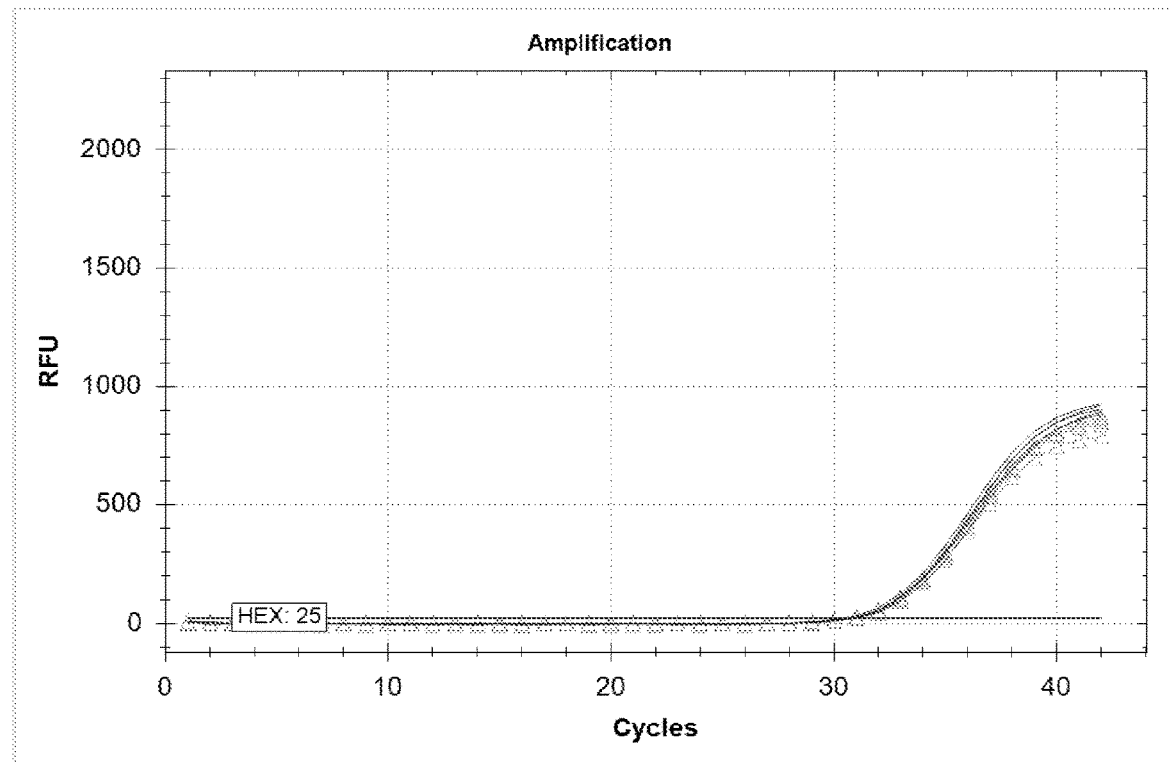

To set up the amplification curves for the EIF3E(e1/e2) wild-type, serial dilution of the positive control plasmids containing the EIF3E(e1/e2) wild-type wild-type is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmids and the internal control are shown in FIGS. 17A and 17B, with the respective Ct values indicated below each amplification plot.

Example 19—PCR Protocol for Single-Plexed RSPO2(e1/e2) Wild-Type Positive Plasmid Control Verification The PCR reagent used is the same as in Example 1.

Master Mix Preparation

The master mix for the PCR reaction is prepared as set out in Table 38 (reaction volume=25 μl).

TABLE 36

| | Description | µl in each 25 µl reaction |
|---|---|---|
| Primer & Probes | RSPO2(e1/e2) wild-type primer-probe mix (SEQ ID NO: 42 or 43; 44 or 45; and 58 ot 59) | 1.00 |
| | Internal control primer-probe mix (SEQ ID NO: 16, 17 and 50) | 1.00 |
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | RSPO2(e1/e2) wild-type positive control plasmid | 2.50 |
| | Total Volume | 25 |

The RT-PCR cycling conditions are the same as in Example 1.

Data Analysis

TABLE 37

| | Target | Dye/Channel | Threshold |
|---|---|---|---|
| 1 | RSPO2 (e1/e2) wild-type | Cy5 | 50 RFU |
| 2 | Internal Control | HEX | 25 RFU |

Figure 18:
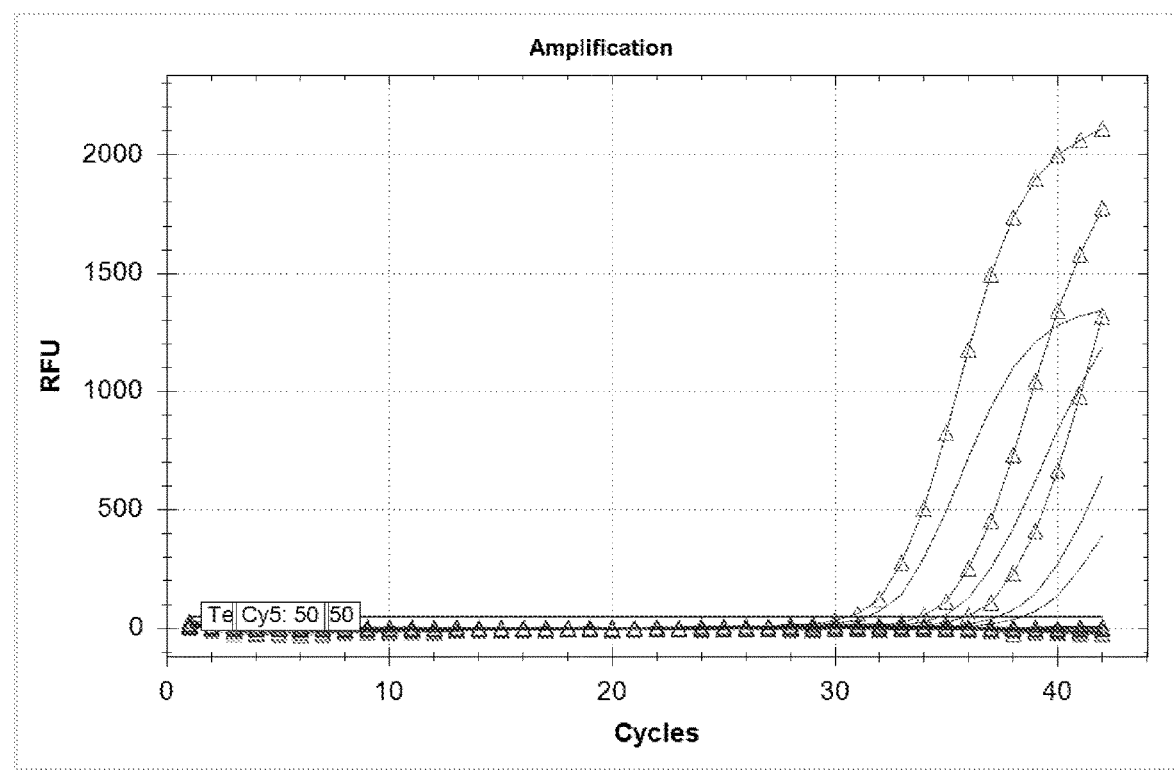
FIG. 18 shows the amplification plots of RSPO2(e1/e2) wild-type (A) and the internal control (B). Each sample contains 100 copies of the internal control plasmids and 1000, 100, 10 or 1 copies of the positive control plasmid respectively. The results show that the PCR amplification reactions designed can successfully amplify the RSPO2(e1/e2) wild-type positive control plasmids and the internal control plasmids.
Figure 18:
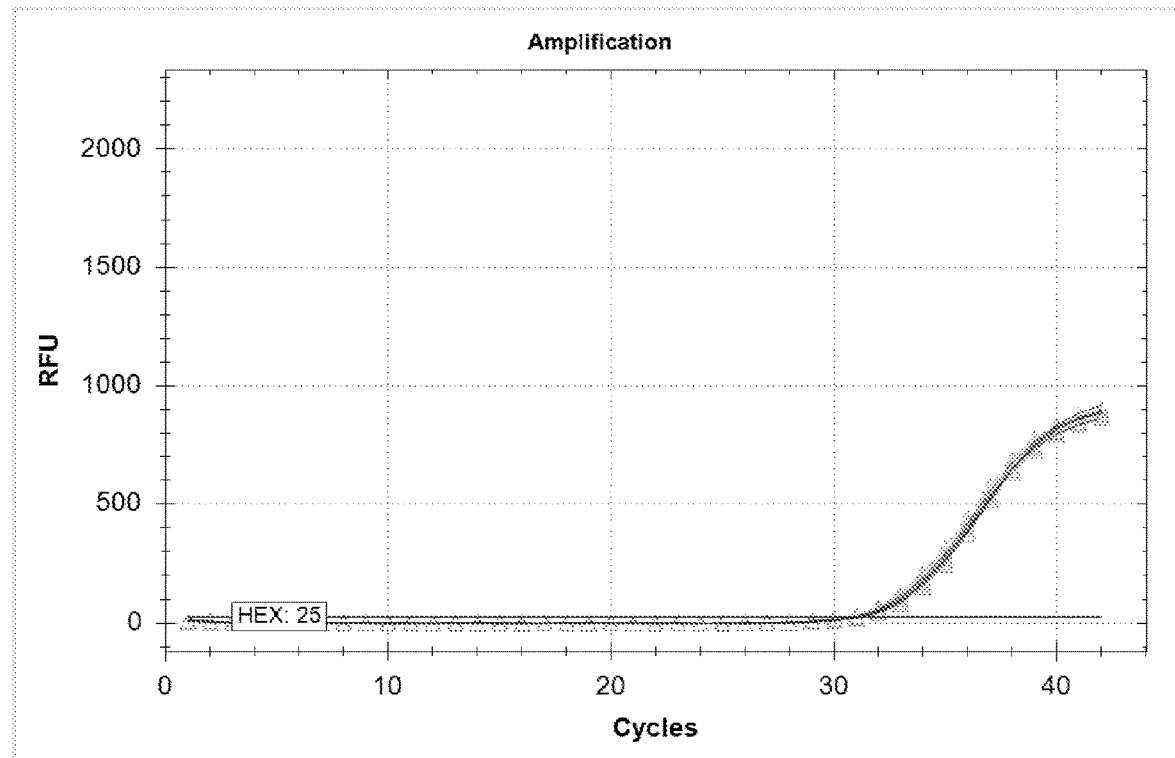

To set up the amplification curves for the RSPO2(e1/e2) wild-type, serial dilution of the positive control plasmids containing the RSPO2(e1/e2) wild-type is carried out, such that the samples for the positive control plasmids contain 1000, 100, 10 and 1 copies of the positive control plasmid respectively. 100 copies of the internal control plasmid is added in each sample. The amplification plots of the samples containing the serially diluted positive control plasmids and the internal control are shown in FIGS. 18A and 18B, with the respective Ct values indicated below each amplification plot.

Example 23—PCR Protocol for Multiplexed Detection of EIF3E(e1)+RSPO2(e2) Fusion, EIF3E(e1/e2) Wild-Type and RSPO2(e1/e2) Wild-Type in Human Total RNA The PCR reagent used is the same as in Example 1.

Master Mix Preparation

The master mix for the PCR reaction is prepared as set out in Table 38 (reaction volume=25 µl).

TABLE 38

| | Description | µl in each 25 µl reaction |
|---|---|---|
| Primer & Probes | EIF3E(e1) + RSPO2(e2) fusion primer-probe mix (SEQ ID NO: 35 or 36; 37 and 56), EIF3E(e1/e2) wild-type primer-probe mix (SEQ ID NO: 39, 40 and 57), and RSPO2(e1/e2) wild-type primer-probe mix (SEQ ID NO: 42 or 43; 44 or 45; and 58 ot 59) | 1.00 |
| | Internal control primer-probe mix (SEQ ID NO: 16, 17 and 50) | 1.00 |

TABLE 38-continued

| | Description | µl in each 25 µl reaction |
|---|---|---|
| Reagents | SuperScriptIII RT/Plt Taq mix (50x) | 0.50 |
| | Reaction mix (2x) | 12.50 |
| | Internal control template | 0.10 |
| | Nuclease-free water | 7.40 |
| Test sample | Human total RNAs | 2.50 |
| | Total Volume | 25 |

The RT-PCR cycling conditions are the same as in Example 1.

Data Analysis

TABLE 39

| | Target | Dye/Channel | Threshold |
|---|---|---|---|
| 1 | EIF3E(e1) + RSPO2(e2) fusion | FAM | 50 RFU |
| 2 | EIF3E(e1/e2) wild-type | TxRd | 50 RFU |
| 3 | RSPO2(e1/e2) wild-type | Cy5 | 50 RFU |
| 4 | Internal Control | HEX | 25 RFU |

Figure 19:
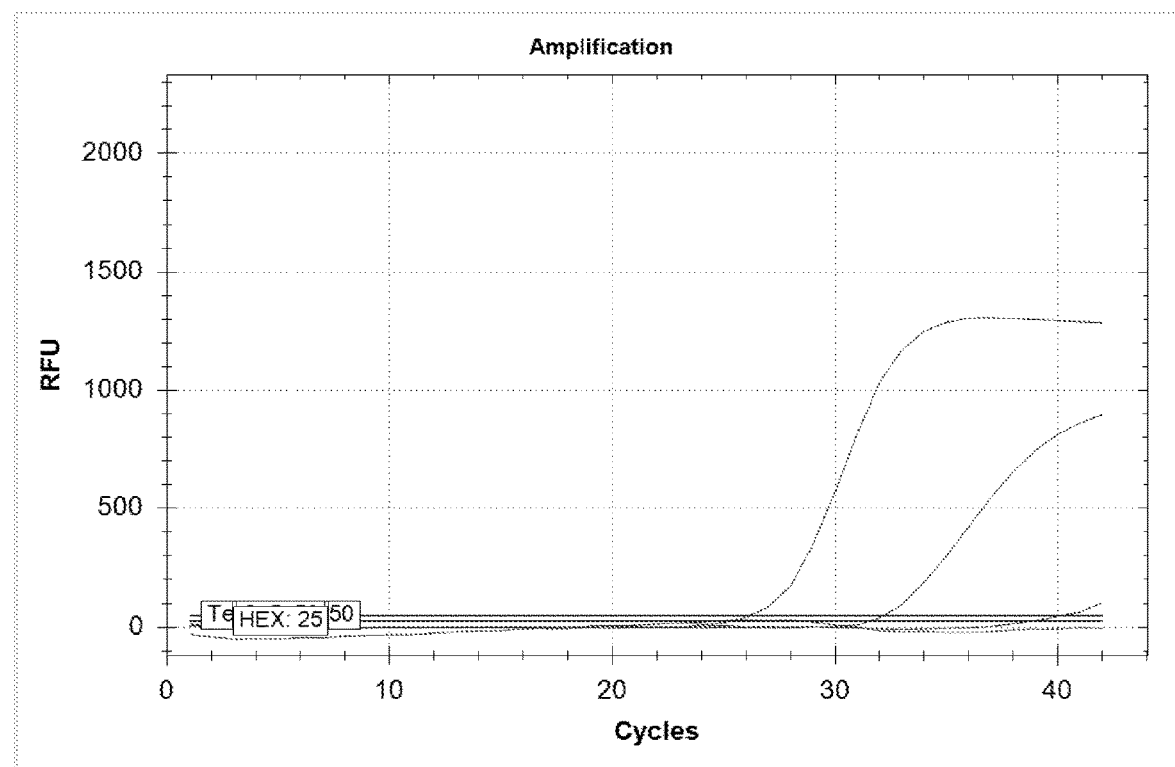
FIG. 19 shows the amplification plots of the multiplexed-detection of EIF3E(e1)+RSPO2(e2) fusion, EIF3E(e1/e2) wild-type, and RSPO2(e1/e2) wild-type and the internal control in the samples containing the human total RNAs. The results show that no EIF3E(e1)+RSPO2(e2) gene-fusion has been detected in the normal human total RNAs.
Figure 19:
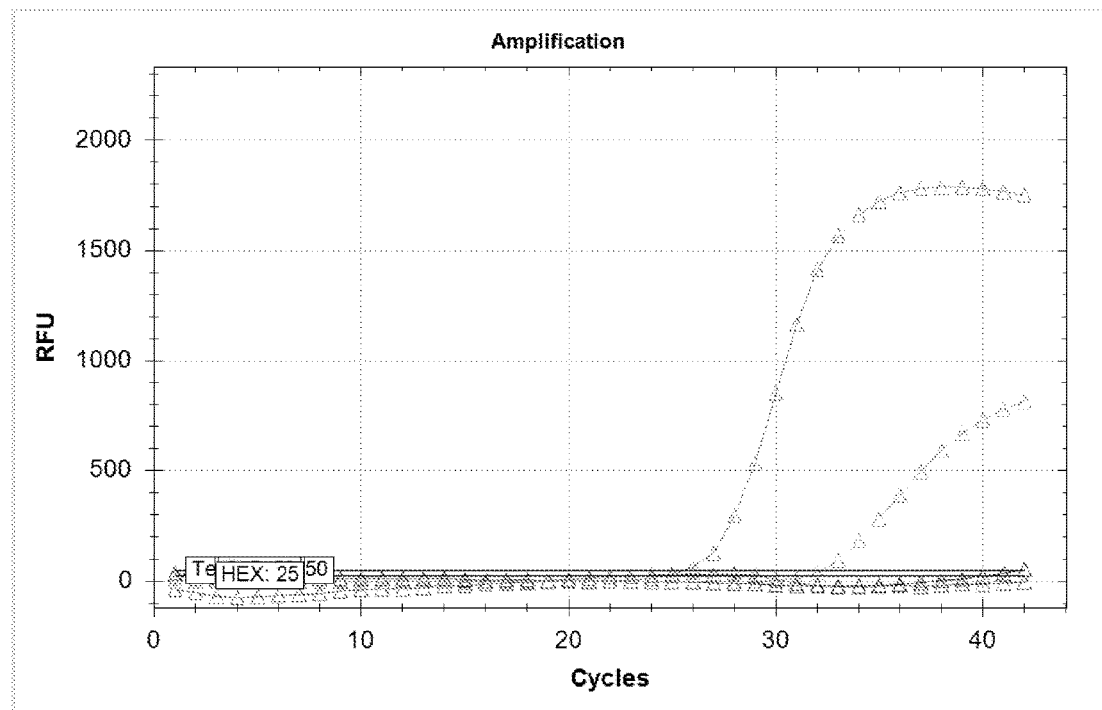
Figure 20:
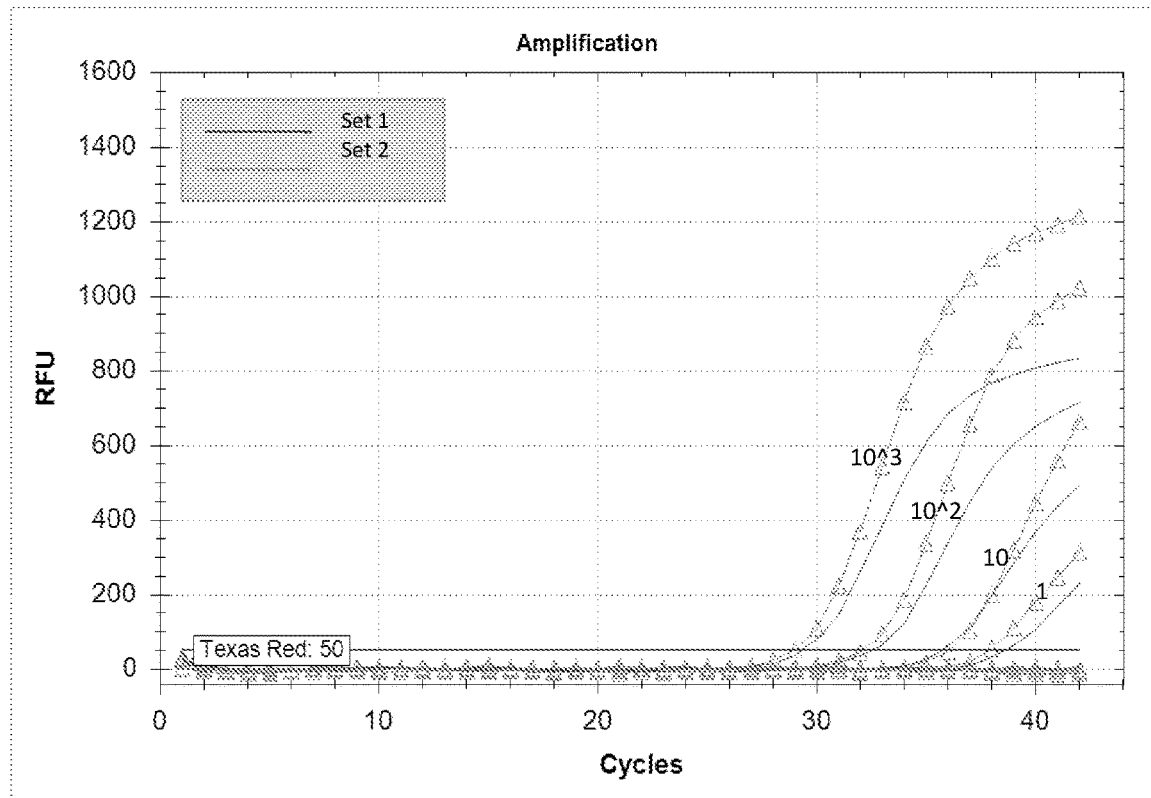
FIG. 20 shows the amplification plots of PTPRK(e13)+RSPO3(e2) fusion (A) and the internal control (B). Each sample contains 100 copies of the internal control plasmids and 1000, 100, 10 or 1 copies of the positive control plasmid respectively. The results show that the PCR amplification reactions designed can successfully amplify the PTPRK(e13)+RSPO3(e2) fusion positive control plasmids and the internal control plasmids. In Set 1, 200 nM of forward primer, 200 nM of reverse primer, and 100 nM of probe are used. In Set 2, 300 nM of forward primer, 300 nM of reverse primer, and 150 nM of probe are used. The average ΔCt value for the Fusion C: FAM table shown in (A) is 0.26. The average ΔCt value for the IC77: HEX table shown in (B) is −0.10.
Figure 20:
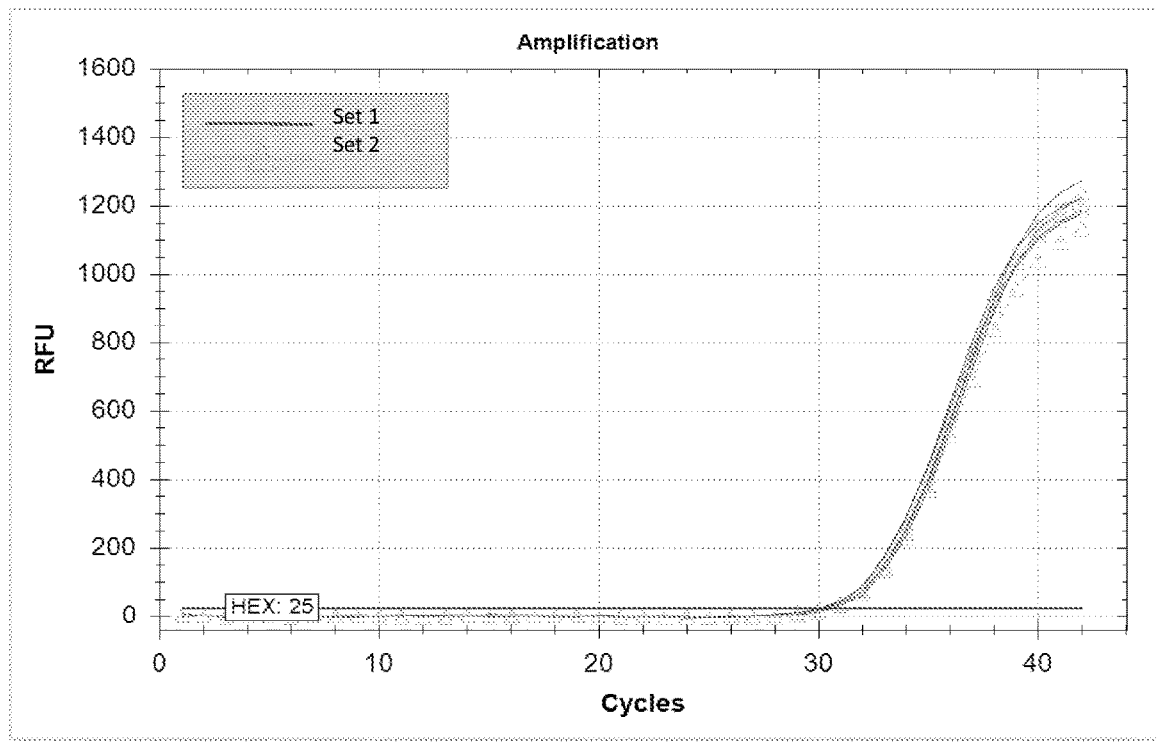
Figure 21:
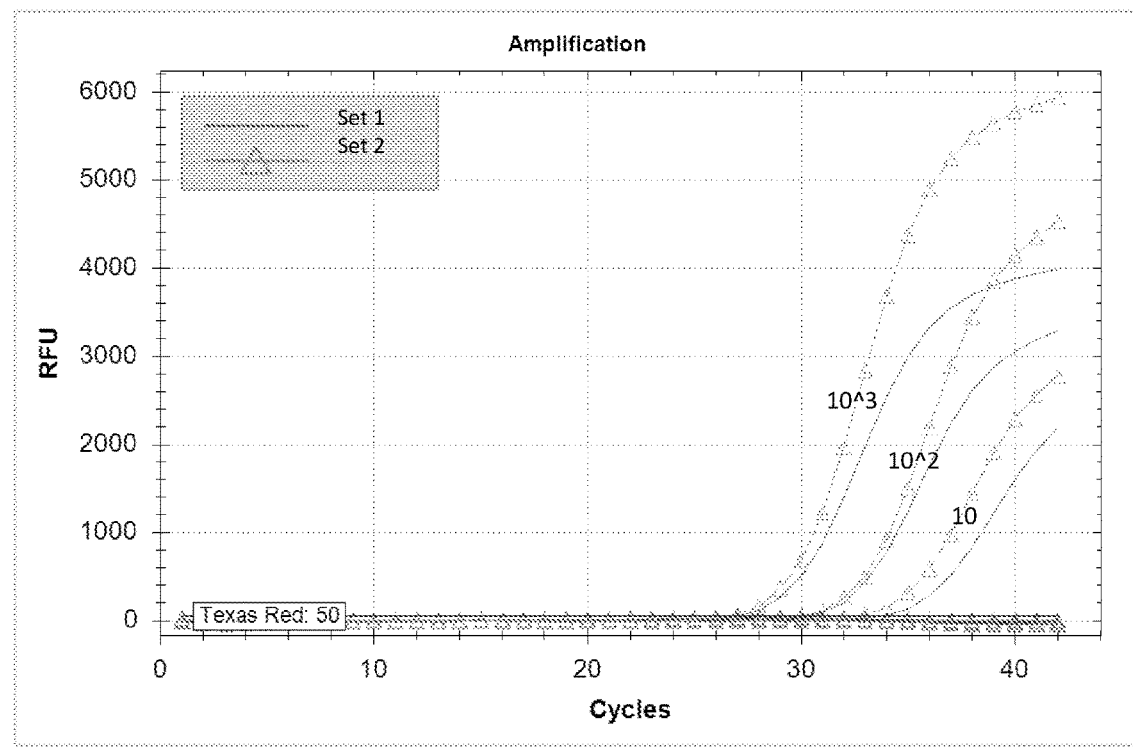
FIG. 21 shows the amplification plots of PTPRK(e12-e14) wild-type (A) and the internal control (B). Each sample contains 100 copies of the internal control plasmids and 1000, 100, 10 or 1 copies of the positive control plasmid respectively. The results show that the PCR amplification reactions designed can successfully amplify the PTPRK(e12-e14) wild-type positive control plasmids and the internal control plasmids. In Set 1, 200 nM of forward primer, 200 nM of reverse primer, and 100 nM of probe are used. In Set 2, 300 nM of forward primer, 300 nM of reverse primer, and 150 nM of probe are used. The average ΔCt value for the PTPRK: TxRd table shown in (A) is 1.72. The average ΔCt value for the IC77: HEX table shown in (B) is 0.11.
Figure 21:
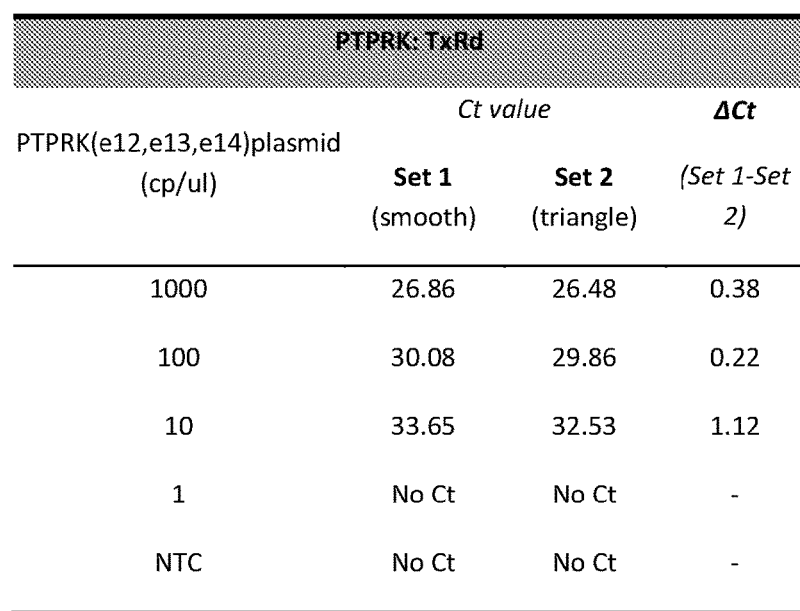
Figure 21:
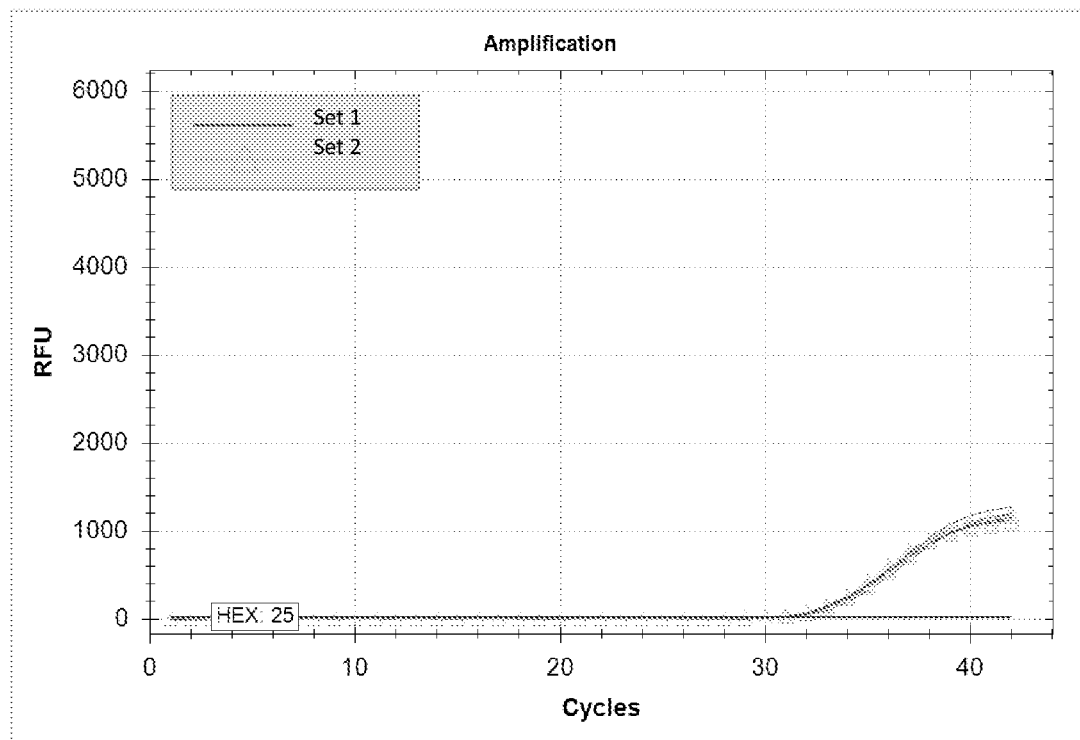
Figure 22:
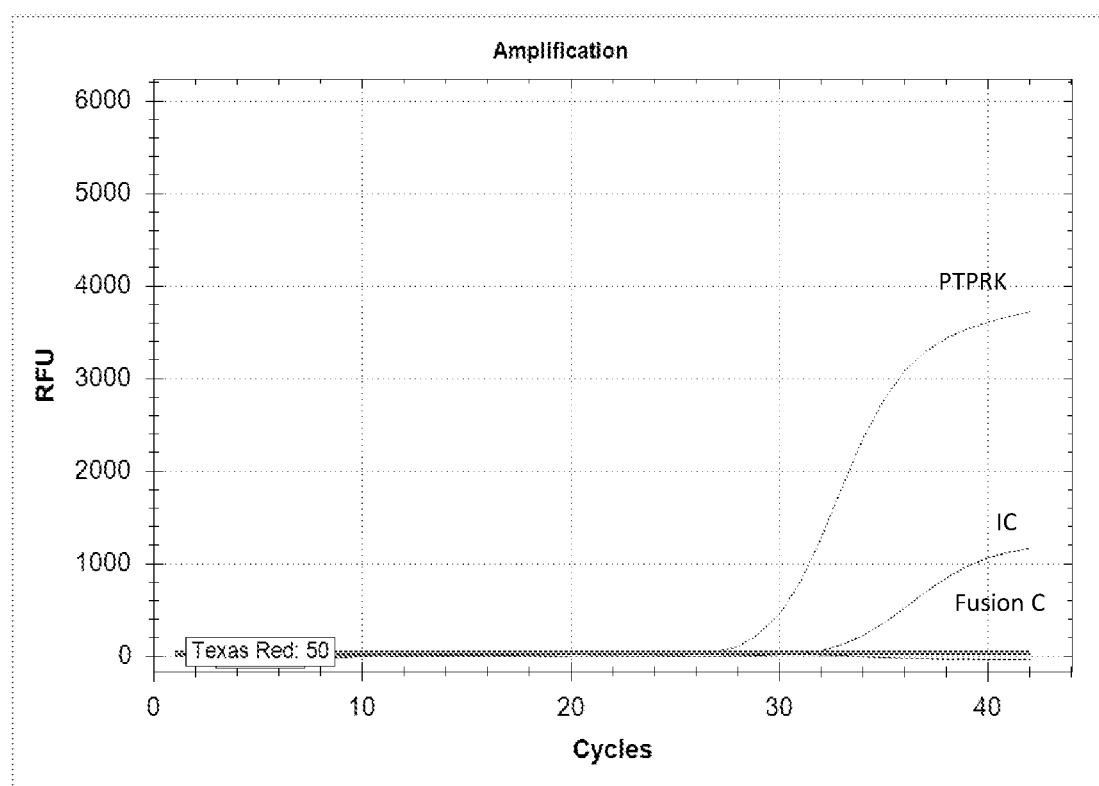
FIG. 22 shows the amplification plots of the multiplexed-detection of PTPRK(e13)+RSPO3(e2) fusion, PTPRK(e12-e14) wild-type, and the internal control in the samples containing the human total RNAs. The results show that no PTPRK(e13)+RSPO3(e2) gene-fusion has been detected in the normal human total RNAs. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 22:
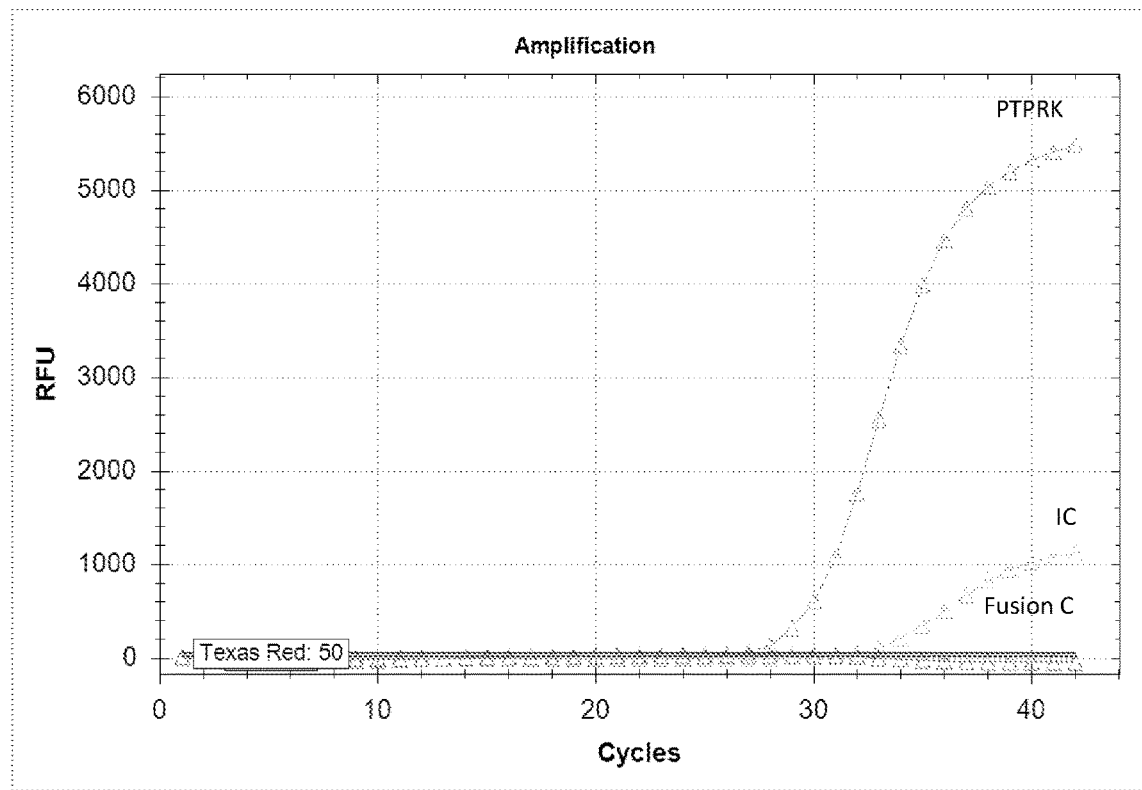
Figure 23:
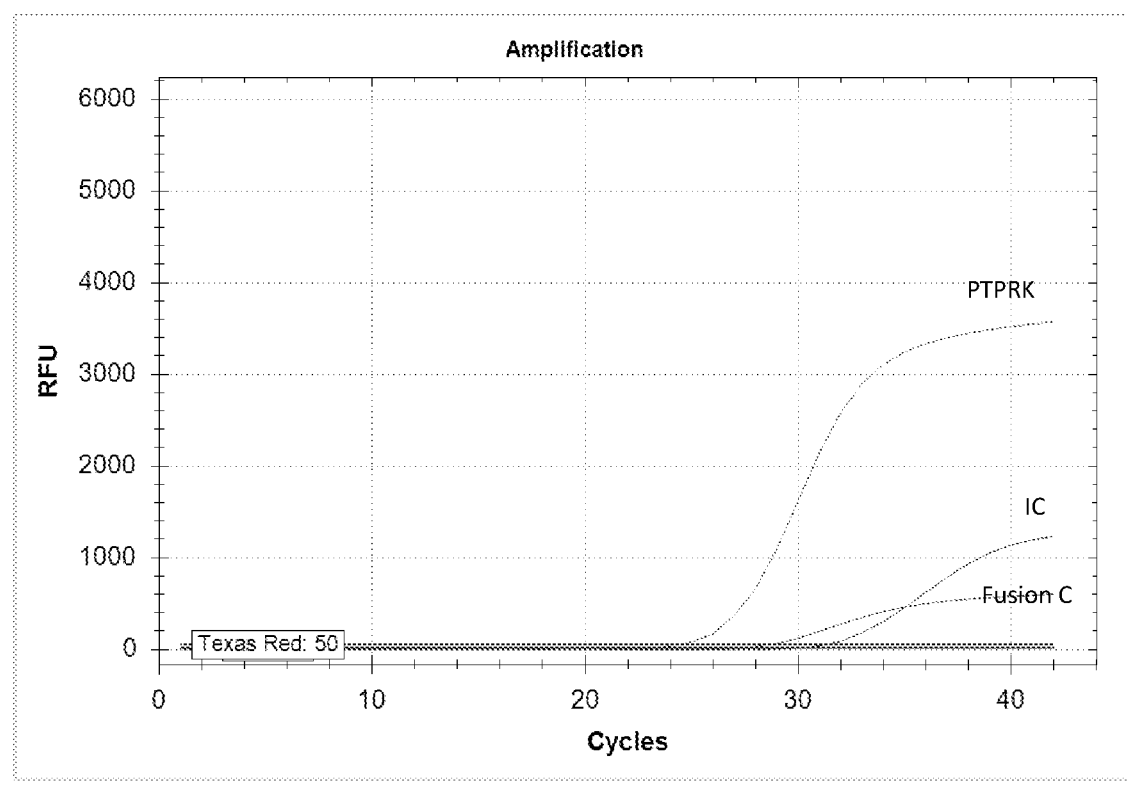
FIG. 23 shows the amplification plots of the multiplexed-detection of PTPRK(e13)+RSPO3(e2) fusion, PTPRK(e12-e14) wild-type, and the internal control in the samples containing the CR2506 tumour RNA. CR2506 tumour was known to contain the PTPRK(e13)+RSPO3(e2) gene-fusion. The respective Ct values are indicated below (B). The results show that PTPRK(e13)+RSPO3(e2) fusion has been detected in CR2506 tumour RNA samples. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 23:
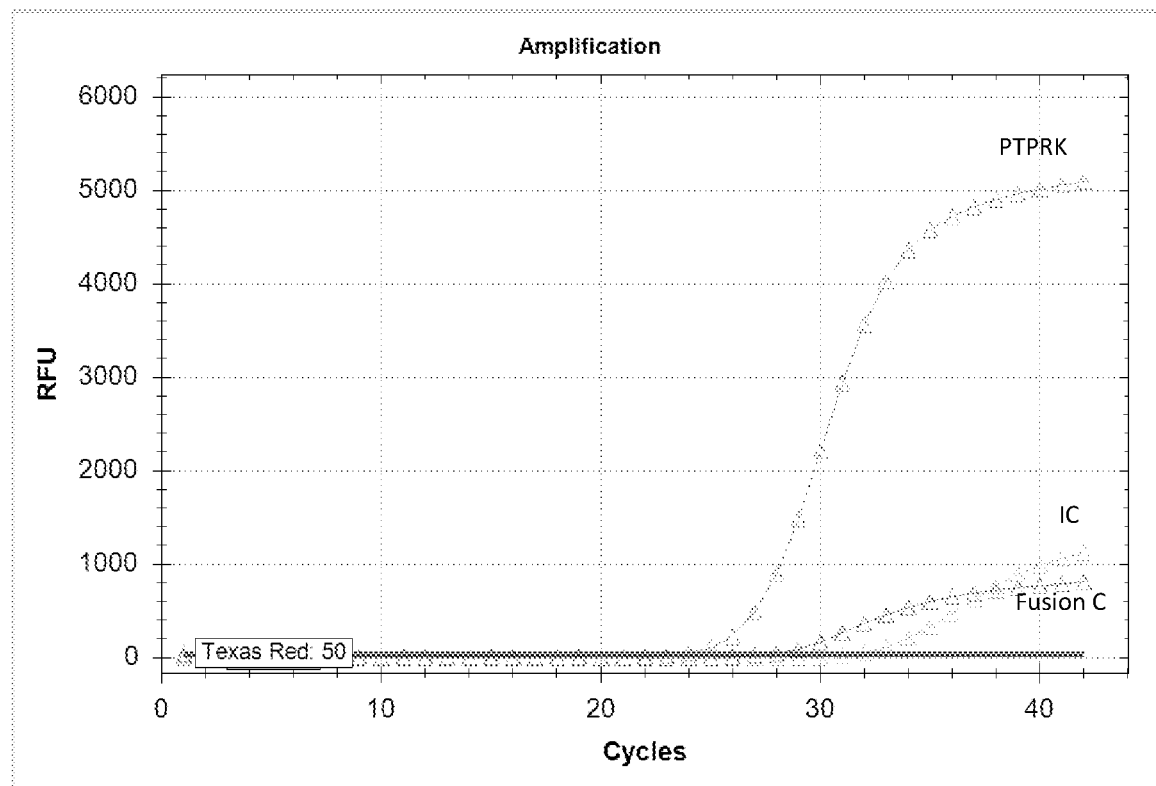
Figure 24:
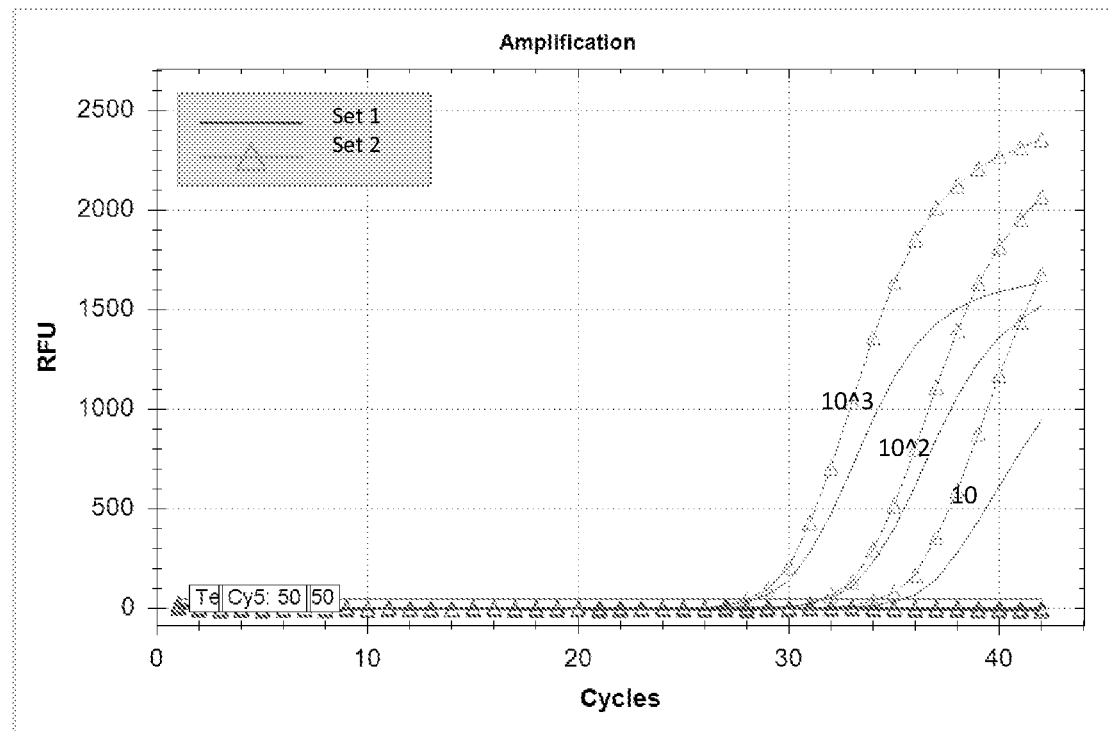
FIG. 24 shows the amplification plots of EIF3E(e1)+RSPO2(e2) fusion (A) and the internal control (B). Each sample contains 100 copies of the internal control plasmids and 1000, 100, 10 or 1 copies of the positive control plasmid respectively. The results show that the PCR amplification reactions designed can successfully amplify the EIF3E(e1)+RSPO2(e2) fusion positive control plasmids and the internal control plasmids. In Set 1, 200 nM of forward primer, 200 nM of reverse primer, and 100 nM of probe are used. In Set 2, 300 nM of forward primer, 300 nM of reverse primer, and 150 nM of probe are used. The average ΔCt value for the Fusion D: FAM table shown in (A) is 0.61. The average ΔCt value for the IC77: HEX table shown in (B) is 0.43.
Figure 24:
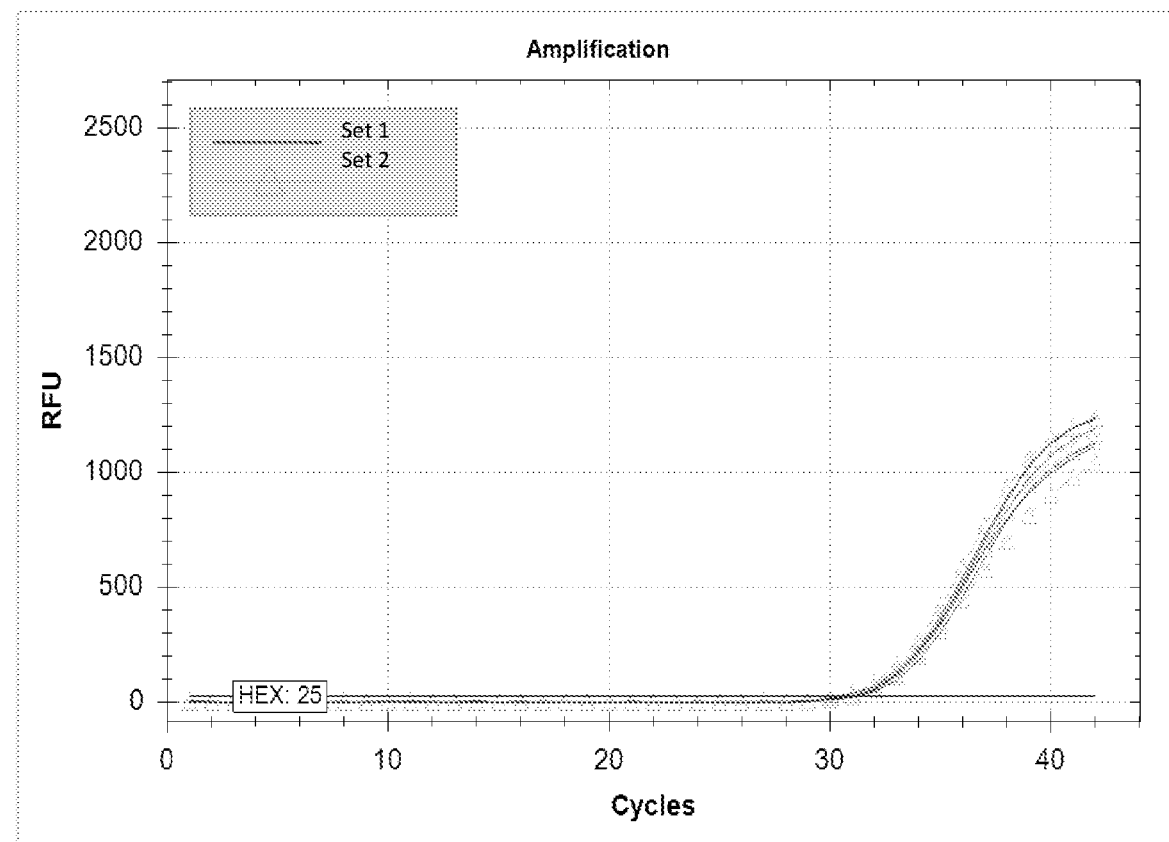
Figure 25:
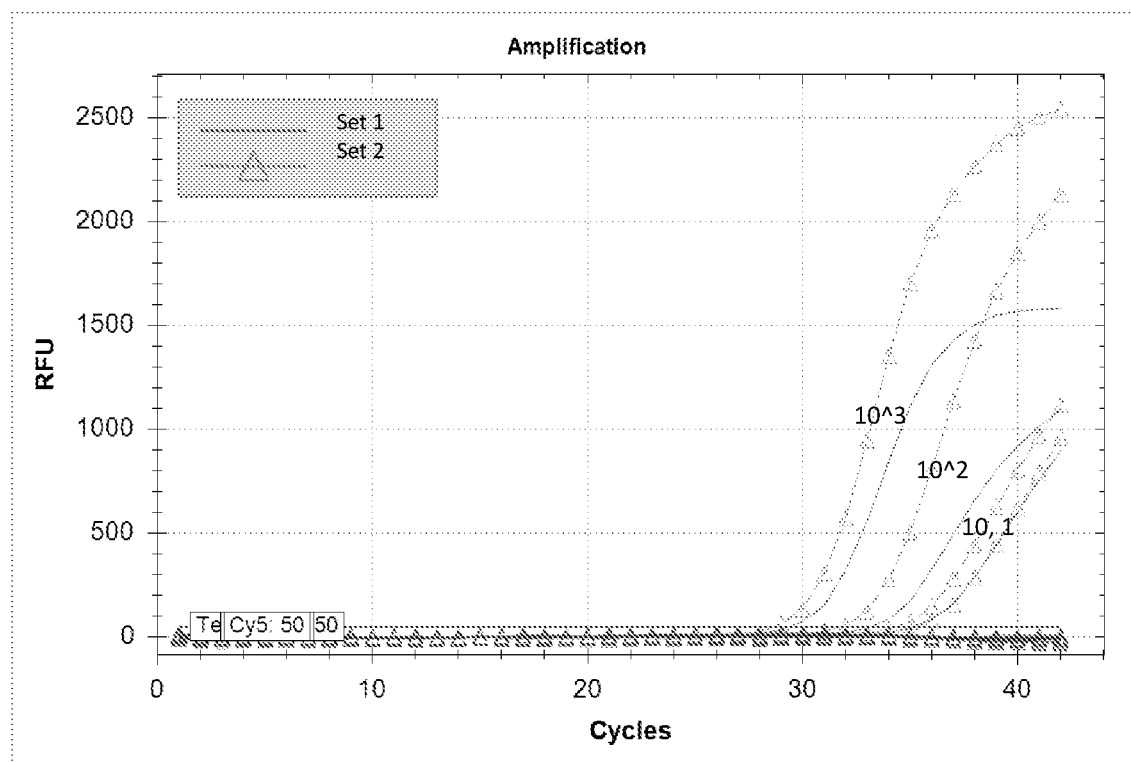
FIG. 25 shows the amplification plots of EIF3E(e1/e2) wild-type (A) and the internal control (B). Each sample contains 100 copies of the internal control plasmids and 1000, 100, 10 or 1 copies of the positive control plasmid respectively. The results show that the PCR amplification reactions designed can successfully amplify the EIF3E(e1/e2) wild-type positive control plasmids and the internal control plasmids. In Set 1, 200 nM of forward primer, 200 nM of reverse primer, and 100 nM of probe are used. In Set 2, 300 nM of forward primer, 300 nM of reverse primer, and 150 nM of probe are used. The average ΔCt value for the EIF3E: TxRd table shown in (A) is 0.99. The average ΔCt value for the IC77: HEX table shown in (B) is 0.47.
Figure 25:
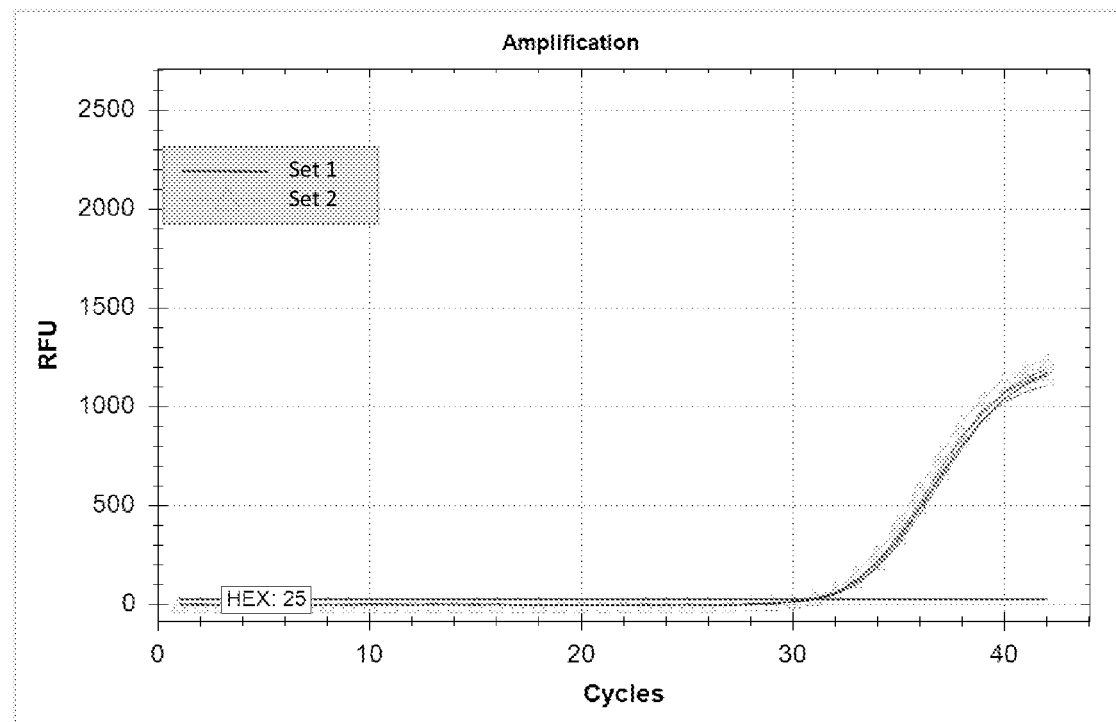
Figure 26:
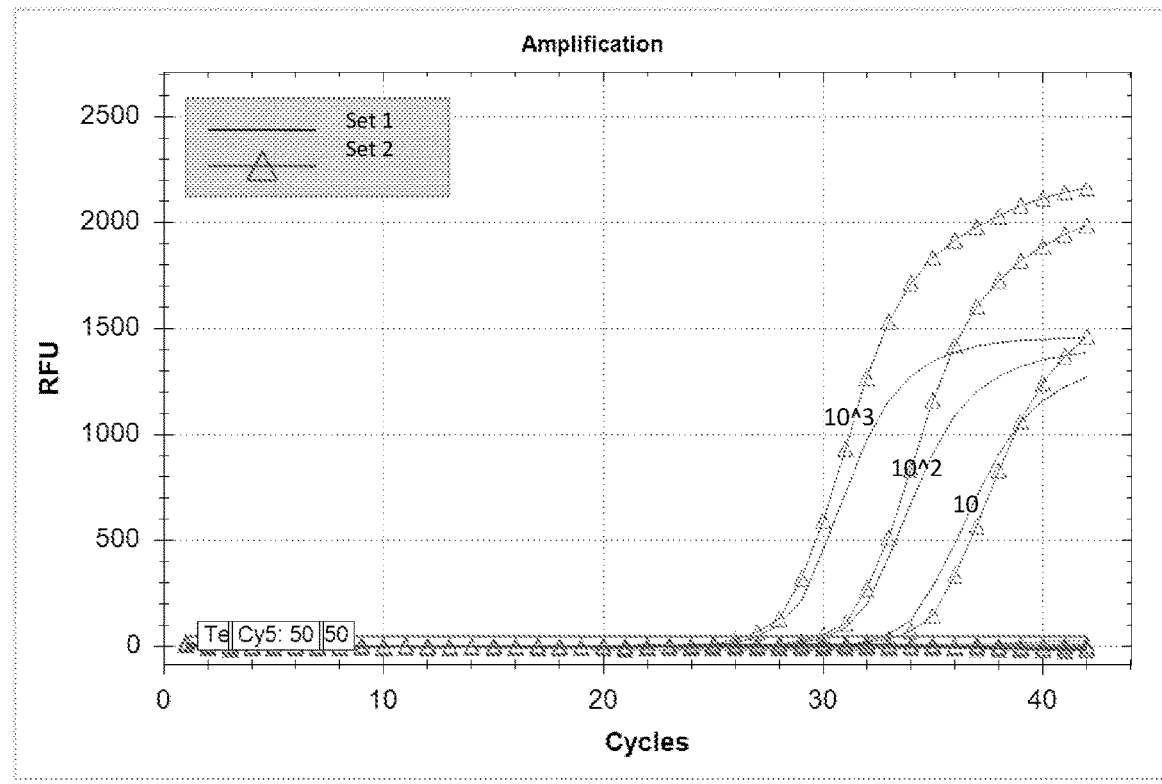
FIG. 26 shows the amplification plots of RSPO2 (e1/e2) wild-type (A) and the internal control (B). Each sample contains 100 copies of the internal control plasmids and 1000, 100, 10 or 1 copies of the positive control plasmid respectively. The results show that the PCR amplification reactions designed can successfully amplify the RSPO2 (e1/e2) wild-type positive control plasmids and the internal control plasmids. In Set 1, 200 nM of forward primer, 200 nM of reverse primer, and 100 nM of probe are used. In Set 2, 300 nM of forward primer, 300 nM of reverse primer, and 150 nM of probe are used. The average ΔCt value for the RSPO2-004: Cy5 table shown in (A) is 0.11. The average ΔCt value for the IC77: HEX table shown in (B) is −0.18.
Figure 26:
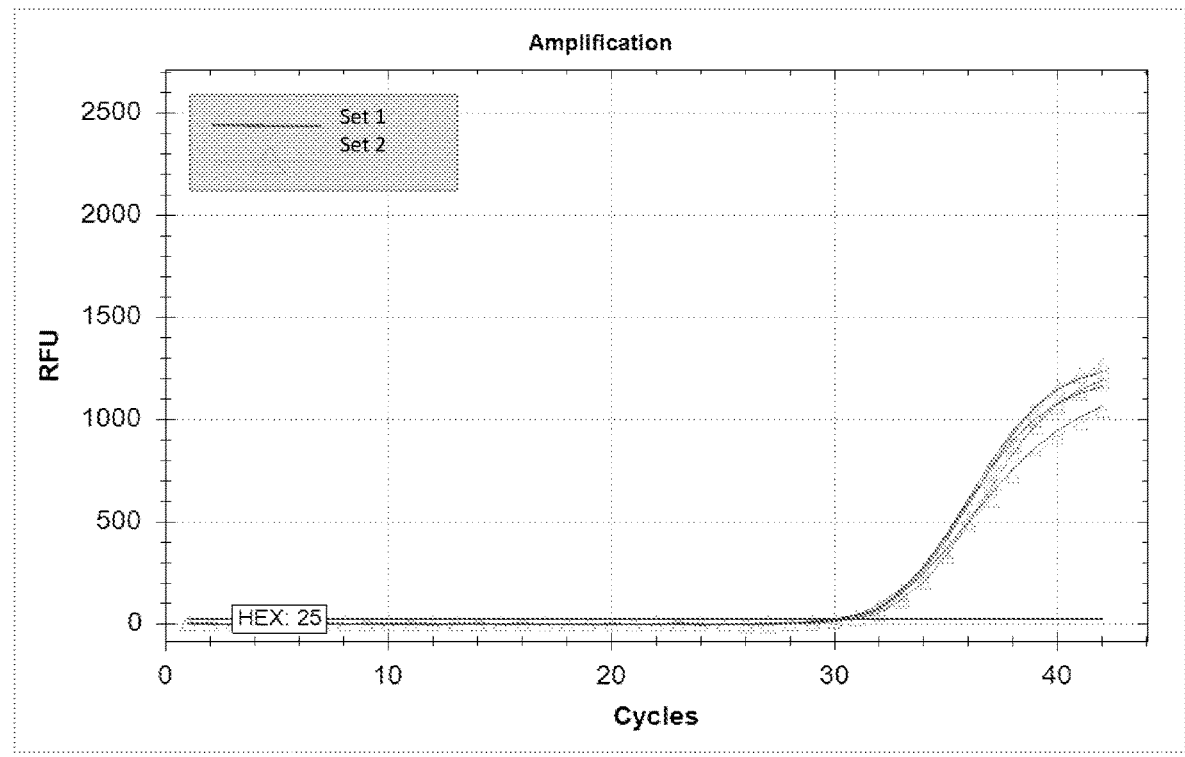
Figure 27:
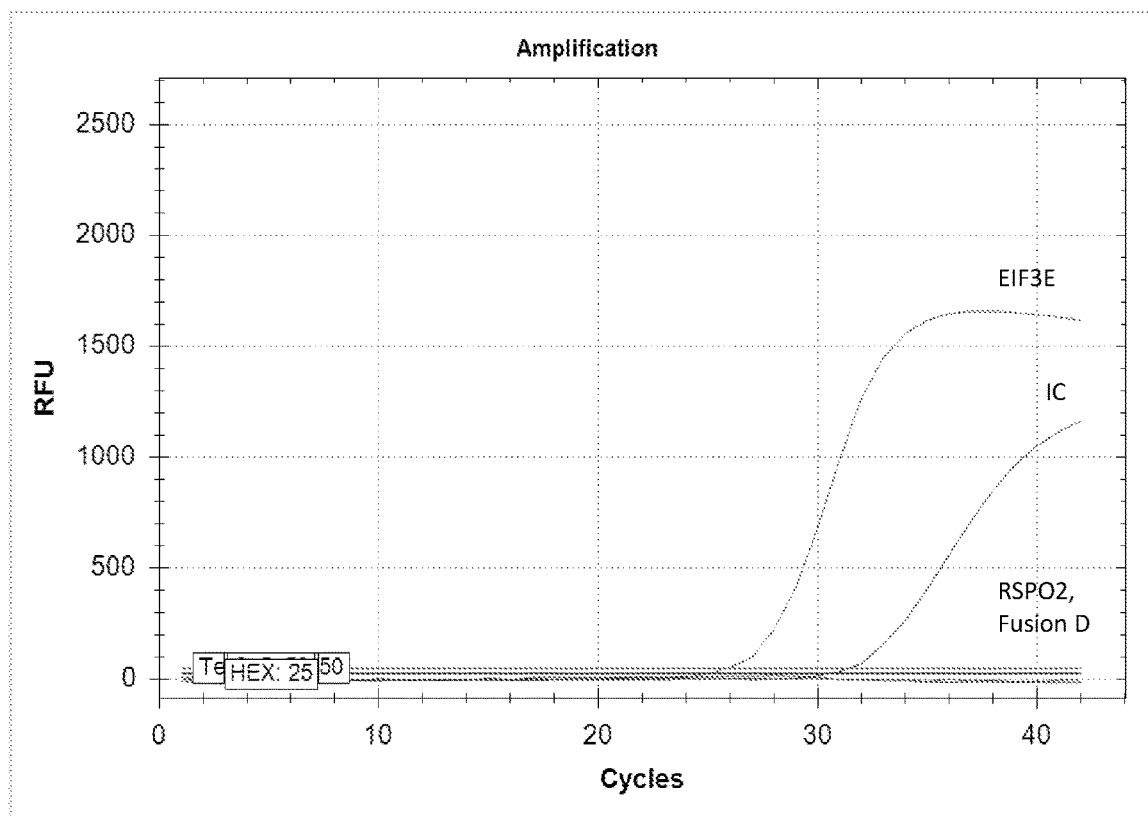
FIG. 27 shows the amplification plots of the multiplexed-detection of EIF3E(e1)+RSPO2(e2) fusion, EIF3E(e1/e2) wild-type, RSPO2 (e1/e2) wild-type and the internal control in the samples containing the human total RNAs. The results show that no EIF3E(e1)+RSPO2(e2) gene-fusion and RSPO2 (e1/e2) wild-type have been detected in the normal human total RNAs. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 27:
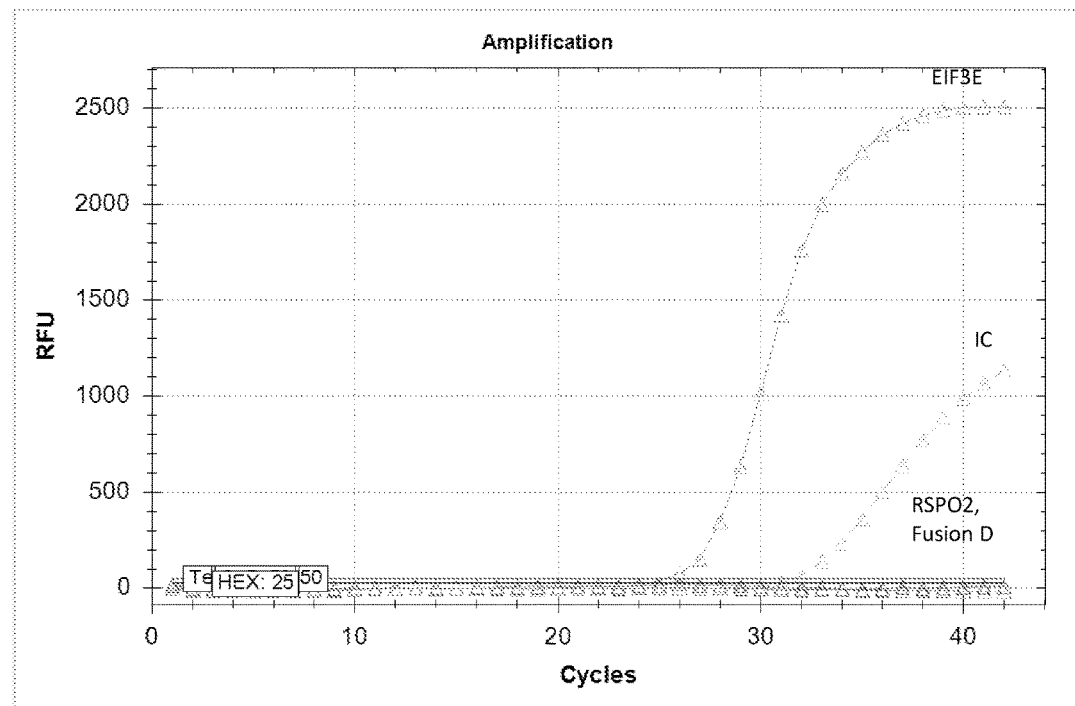
Figure 28:
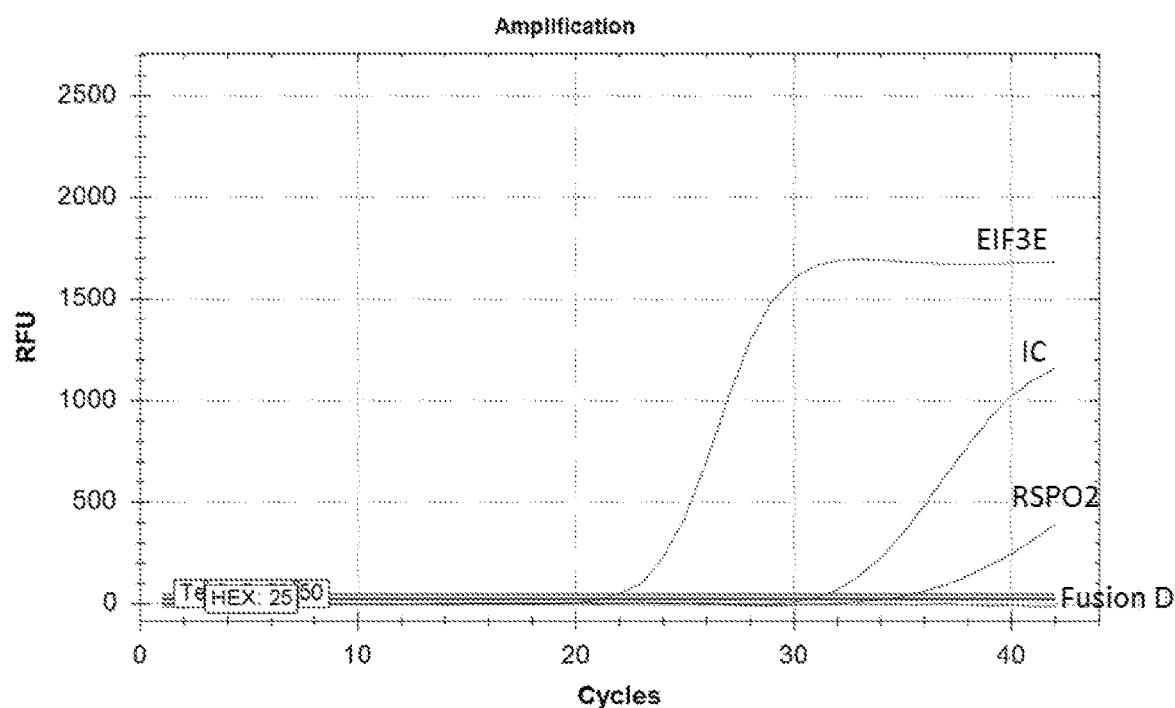
FIG. 28 shows the amplification plots of the multiplexed-detection of EIF3E(e1)+RSPO2(e2) fusion, EIF3E(e1/e2) wild-type, RSPO2 (e1/e2) wild-type and the internal control in the samples containing the CR205 tumour RNAs. The respective Ct values are indicated below (B). The results show that no EIF3E(e1)+RSPO2(e2) gene-fusion has been detected in the CR205 tumour RNAs. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 28:
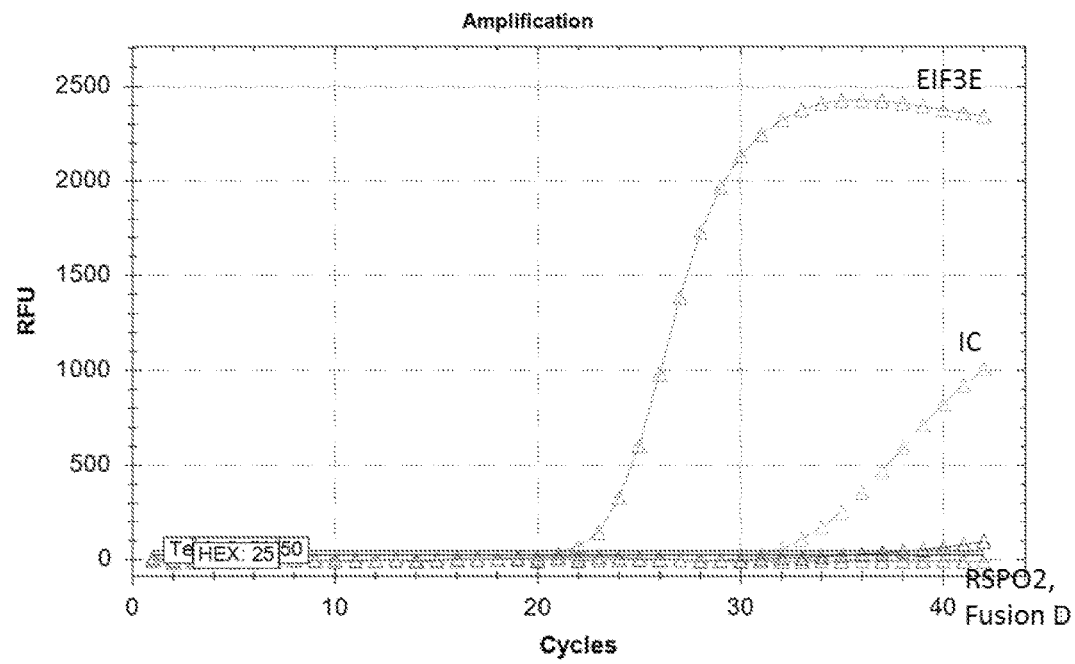
Figure 29:
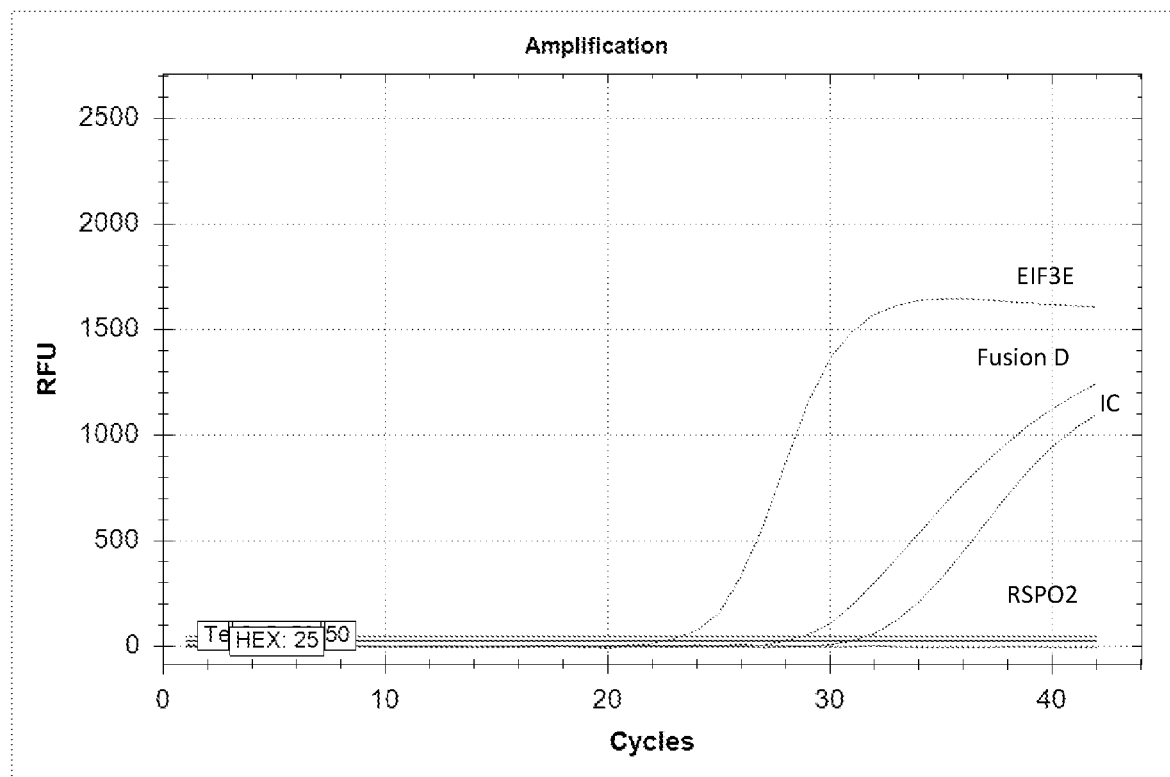
FIG. 29 shows the amplification plots of the multiplexed-detection of EIF3E(e1)+RSPO2(e2) fusion, EIF3E(e1/e2) wild-type, RSPO2 (e1/e2) wild-type and the internal control in the samples containing the CR210 tumour RNAs. CR210 tumour was known to contain the EIF3E(e1)+RSPO2(e2) gene-fusion. The respective Ct values are indicated below (B). The results show that EIF3E(e1)+RSPO2(e2) gene-fusion has been detected in the CR210 tumour RNAs. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 29:
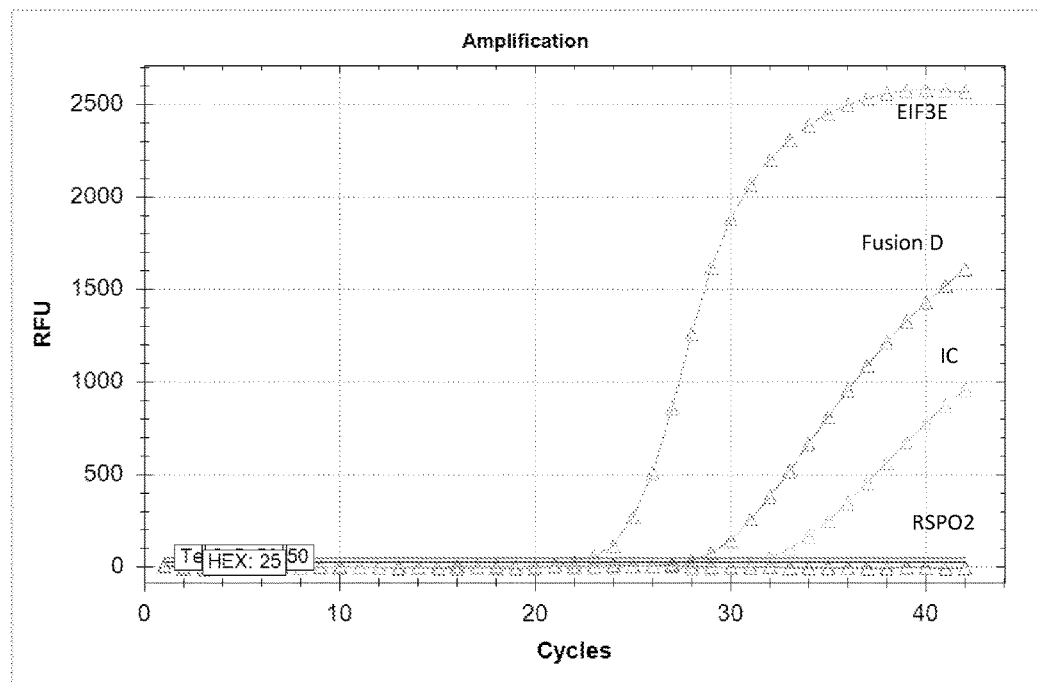
Figure 30:
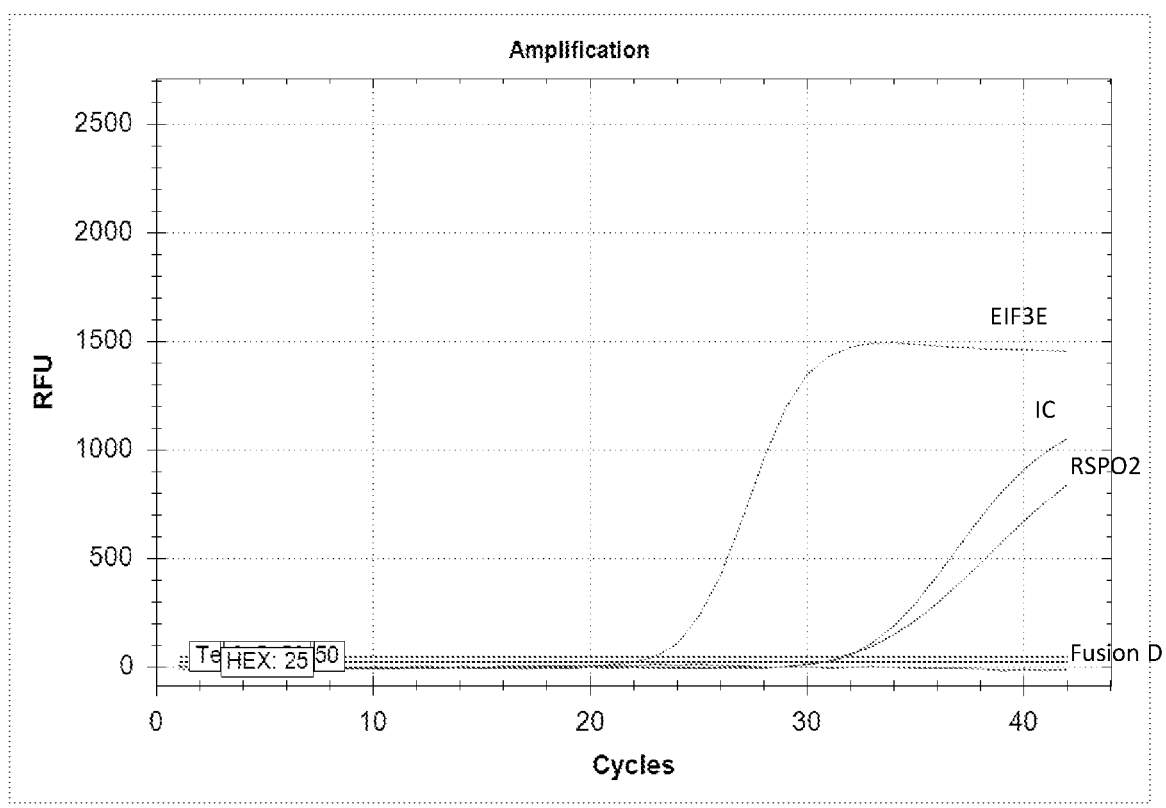
FIG. 30 shows the amplification plots of the multiplexed-detection of EIF3E(e1)+RSPO2(e2) fusion, EIF3E(e1/e2) wild-type, RSPO2 (e1/e2) wild-type and the internal control in the samples containing the CR214 tumour RNAs. The respective Ct values are indicated below (B). The results show that no EIF3E(e1)+RSPO2(e2) gene-fusion has been detected in the CR214 tumour RNAs. In Set 1 (A), 200 nM of forward primer, 200 nM of reverse primer, and 100 nM of probe are used. In Set 2 (B), 300 nM of forward primer, 300 nM of reverse primer, and 150 nM of probe are used.
Figure 30:
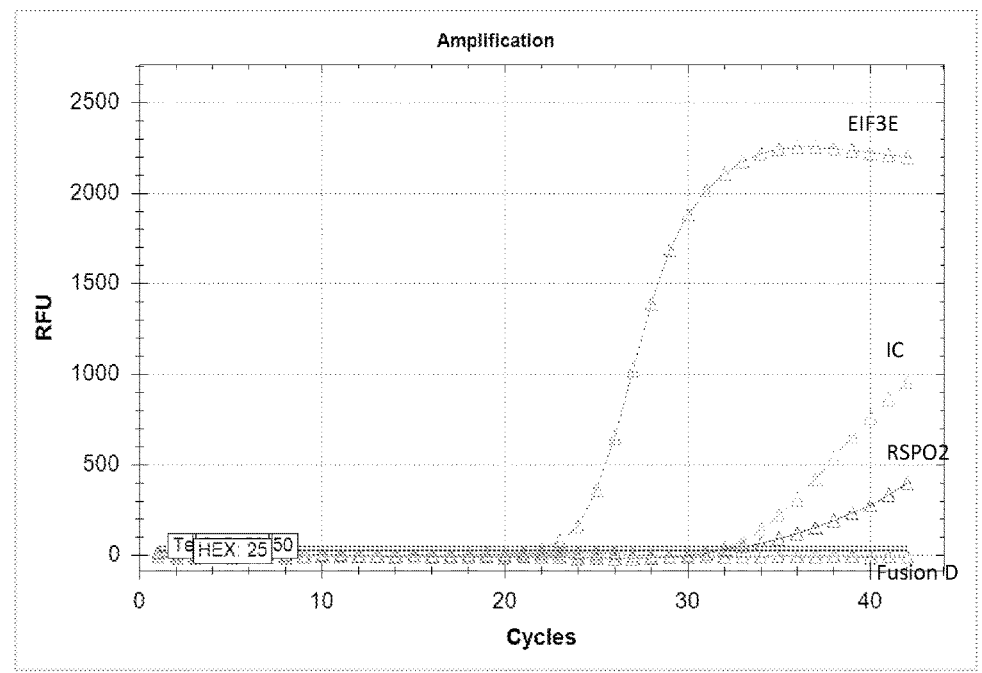

The amplification plots of the multiplexed-detection of EIF3E(e1)+RSPO2(e2) fusion, EIF3E(e1/e2) wild-type, and RSPO2(e1/e2) wild-type and the internal control in the samples containing the human total RNAs are shown in FIGS. 19A and 19B. The respective Ct values are indicated below the amplification plots.

An example of processes used in order to establish acceptance or refusal criteria for results analysis are provided in the following examples.

Example 24—Run Controls Acceptance Criteria

Examples of acceptable run Ct values for use in the results analysis are provided here.

| Assay | Sample | Channel | Acceptable Ct Range* |
|---|---|---|---|
| Fusion A | NTC | FAM | No amplification |
| PTPRK WT | NTC | TxRd | No amplification |
| RSPO3 WT | NTC | Cy5 | No amplification |

*Acceptable values are within, and including the values specified, unless stated otherwise. No amplification indicates Ct > 42.

For positive controls (PC), ensure that the FAM, TxRd, and Cy5 signals for each PC reaction are within the Ct range. If the Ct value is outside the acceptable range, proceed to example 25.

No Template Control (NTC)

Ensure that each NTC reaction shows no amplification (i.e. Ct>42) in the FAM, TxRd, and Cy5 reactions (amplification would indicate contamination). If any NTC assay shows amplification in the FAM, TxRd, and/or Cy5 channels, i.e., a Ct value of less than or equal to 42, proceed to example 25.

Internal Control (IC)

PC wells will not be assessed for IC (HEX) amplification as this reaction may be out-competed by the fusion/WT assay reaction. Ensure that each NTC reaction shows a Ct value for the HEX channel (IC) which is within range. If any NTC reaction has a HEX value outside an acceptable range, then the run has failed the run control acceptance criteria and the operator should proceed to example 25. If all the run controls are within the acceptable ranges then proceed to example 26.

Example 25—Run Controls Re-Test Criteria

If the run controls have failed the criteria specified in example 24, then the user should proceed as described below. Details of re-tests carried out and, where necessary, investigations and justifications will be detailed in an appendix to the study report. Deviations will be recorded where necessary.

Positive Control (PC)

If FAM, TxRd, and Cy5 Ct values are out of specification for any reaction, then the entire run is invalid and must be repeated. The invalid run will be logged; where the failure appears to be systemic (as opposed to sporadic) the cause of the failure will be investigated and recorded. The investigation will also consider whether the study should be repeated or can be continued from the point at which the problem manifested.

The invalid run may be repeated twice; if the same FAM, TxRd, and C5 Ct values remain out of specification then the cause will be deemed systemic and investigated accordingly. Should a repeat run fail for a different reason, e.g., NTC contamination, then that failure will not count towards the number of repeats that may be performed due to the original failure reason.

No Template Control (NTC)

If amplification is detected in the FAM, TxRd, and/or Cy5 channel before Ct 42 (or at Ct 42) for any NTC reaction, the entire run will be deemed invalid. The invalid run will be logged; where the failure appears to be systemic (as opposed to sporadic) the cause of the failure will be investigated and recorded. The investigation will also consider whether the study should be repeated or can be continued from the point at which the problem manifested.

The invalid run may be repeated twice; if the same FAM, TxRd, and/or Cy5 contaminations remain then the cause will be deemed systemic and investigated accordingly. Should a repeat run fail for a different reason, e.g., PC failure, then that failure will not count towards the number of repeats that may be performed due to the original failure reason.

Internal Control (IC)

If the IC (HEX) Ct value is out of specification in the NTC then the reaction is invalid. Data from that reaction cannot be used; the entire run will be deemed invalid. The invalid run will be logged; where the failure appears to be systemic (as opposed to sporadic) the cause of the failure will be investigated and recorded. The investigation will also consider whether the study should be repeated or can be continued from the point at which the problem manifested.

The invalid run may be repeated twice; if the same IC (HEX) Ct remains out of specification then the cause will be deemed systemic and investigated accordingly. Should a repeat run fail for a different reason, e.g., PC failure, then that failure will not count towards the number of repeats that may be performed due to the original failure reason.

Example 26—Samples Acceptance Criteria

To confirm that reactions containing sample are valid, they should be checked as described below.

Samples: PTPRK WT Reaction Acceptance Criteria

Ensure that the PTPRK WT Reaction TxRd Ct value for each sample is within a range, which verifies that the assay has not been over loaded or that insufficient DNA has not been used. If the Ct values are within range then the sample PTPRK WT Reaction acceptance criteria have been met and the sample fusion reaction can be assessed. The operator should proceed to Section "Samples: Fusion Assay Acceptance Criteria" below. If the Ct value is outside the acceptable range, then all reactions using that sample are invalid and the data cannot be used. The operator should proceed to the re-test criteria in Example 27.

Samples: RSPO3 WT Reaction Acceptance Criteria

| Reaction Mix | Channel | Upper Acceptable Ct Range* |
|---|---|---|
| RSPO3 WT | Cy5 | 42.00 |

*Acceptable values are within, and including the values specified, unless stated otherwise.

Ensure that the RSPO3 WT Reaction Cy5 Ct value for each sample is within the range, shown in the table above. If the Cy5 Ct values are within range then the sample RSPO3 WT Reaction acceptance criteria have been met and the sample fusion reaction can be assessed. The operator should proceed to Section "Samples: Fusion Assay Acceptance Criteria" below. If the Cy5 Ct value is outside the acceptable range but the TxRd Ct value is within the range shown above, then all reactions using that sample are still valid and the data will be used. The operator should proceed to Section "Samples: Fusion Assay Acceptance Criteria" below. If the Cy5 Ct value is outside the acceptable range and the TxRd Ct value is also outside the acceptable range of the PTPRK WT reaction mix, then all reactions using that sample are invalid and the data cannot be used. The operator should proceed to the re-test criteria in Example 27.

Samples: Fusion Assay Acceptance Criteria

| Fusion Reaction | Channel | Acceptable Ct Range* |
|---|---|---|
| Fusion A | FAM | 0.00-42.00 |

*Acceptable values are within, and including, the values specified.

If the FAM Ct is above the acceptable range stated in the table above or there is no FAM amplification, the operator should proceed to Section "Samples: Internal Control (HEX) Acceptance Criteria" below to assess the IC (HEX). If the IC (HEX) is valid, then the result is deemed "Mutation Not Detected". These samples will not be repeated and will contribute to the data set which will support the statistical analysis.

Samples: Internal Control (HEX) Acceptance Criteria

For reactions with positive amplification in the FAM/TxRd/Cy5 reaction (i.e. Ct≤42), the IC HEX Ct does not have to be within a specified range, because it may be out-competed by the FAM/TxRd/Cy5 reaction. In cases where there are no FAM, TxRd, and Cy5 amplifications then the HEX Ct values must fall within a specified range, otherwise the reaction will be deemed to have failed and will be subjected to the re-test criteria described in example 27 below.

Example 27—Samples Re-Test Criteria

Samples: PTPRK WT Reaction Re-Test Criteria

If the sample has failed the criteria specified in example 26, then the user should proceed as described below. Details of re-tests carried out and, where necessary, investigations and justifications will be detailed in an appendix to the study report. Deviations will be recorded where necessary. The invalid sample may be re-tested once; if the same TxRd Ct remains out of specification then the sample must be re-manufactured using the original undiluted 100% Fusion Standards and re-tested. Should a repeat run fail for a different reason, e.g., NTC contamination, then that failure will not count towards the number of repeats that may be performed due to the original failure reason.

Samples: RSPO3 WT Reaction Re-Test Criteria

If the sample has failed the criteria specified in example 26 then the user should proceed as described below. Details of re-tests carried out and, where necessary, investigations and justifications will be detailed in an appendix to the study report. Deviations will be recorded where necessary. The invalid sample may be re-tested once; if the same Cy5 and TxRd Ct values remain out of specification then the sample must be re-manufactured using the original undiluted 100% Fusion Standards and re-tested. Should a repeat run fail for a different reason, e.g., NTC contamination, then that failure will not count towards the number of repeats that may be performed due to the original failure reason.

Samples: Fusion Assay Re-Test Criteria

If the sample has failed the criteria specified in example 26 then the user should proceed as described below. Details of re-tests carried out and, where necessary, investigations and justifications will be detailed in an appendix to the study report. Deviations will be recorded where necessary. The invalid sample may be re-tested once; if the same FAM Ct values remain out of specification then the sample must be re-manufactured using the original undiluted 100% Fusion Standards and re-tested. Should a repeat run fail for a different reason, e.g., NTC contamination, then that failure will not count towards the number of repeats that may be performed due to the original failure reason.

Samples: Internal Control (HEX) Re-Test Criteria

If the sample has failed the criteria specified in example 26 then the user should proceed as described below. Details of re-tests carried out and, where necessary, investigations and justifications will be detailed in an appendix to the study report. Deviations will be recorded where necessary. In cases where there are no FAM, TxRd, and Cy5 amplifications (i.e. Ct>42) and the IC (HEX) Ct values are out of range, these reactions have failed and the data for these reactions cannot be used. The invalid sample may be re-tested once; if the IC (HEX) Ct remains out of specification then the sample must be re-manufactured using the original undiluted 100% Mutation Standards and re-tested. Should a repeat run fail for a different reason, e.g., PC failure, then that failure will not count towards the number of repeats that may be performed due to the original failure reason.

Example 28—Assignment of Sample Fusion Status

Once the run has passed the acceptance criteria then the sample fusion status will be defined as described below.

Calculation of $\Delta Ct$

For every fusion reaction, calculate the $\Delta Ct$ value using the following formula:

$$\Delta Ct = Ct_{fusion\ reaction} - Ct_{PTPRK\ WT\ reaction}$$

Compare the $\Delta Ct$ values to the assay cut-off values provided. If the $\Delta Ct$ value is below or equal to the cut-off, then it is "Fusion Detected". If the $\Delta Ct$ value is below the specified range, i.e. a negative $\Delta Ct$ value, then it is "Fusion Detected". If the $\Delta Ct$ value is above the cut-off, then it is "Fusion Not Detected".

Table of sequences of the sequence listing

| SEQ ID NO | Identity (if applicable; ascension number) |
|---|---|
| 1 | Human PTPRK gene (ENST00000368226.8) |
| 2 | Exon 13 of human PTPRK gene (ENSE00003480723) |
| 3 | Human RSPO3 gene |
| 4 | Exon 2 of the human RSPO3 gene (ENSE00003551533) |
| 5 | Exon 12 of the human PTPRK gene (ENSE00003641852) |
| 6 | Forward primer for the target sequence PTPRK(e13)-RSPO3(e2) fusion |
| 7 | Reverse primer for the target sequence PTPRK(e13)-RSPO3(e2) fusion |
| 8 | Exon 14 of the human PTPRK gene (ENSE00003466930) |
| 9 | Forward primer for the target sequence PTPRK(e12-e14) WT control |
| 10 | Reverse primer for the target sequence PTPRK(e12-e14) WT control |
| 11 | Exon 1 of the human RSPO3 gene (ENSE00001858691) |
| 12 | Forward primer for the target sequence RSPO3 (e1/e2) WT control |
| 13 | Reverse primer for the target sequence RSPO3 (e1/e2) WT control |
| 14 | Another reverse primer for the target sequence RSPO3 (e1/e2) WT control |
| 15 | Another probe for the RSPO2(e1/e2) wild-type control |
| 16 | Forward primer for internal control |
| 17 | Reverse primer for internal control |
| 18 | Exon 1 of the human PTPRK gene (ENSE00002192844) |
| 19 | Forward primer for the target sequence PTPRK(e1)-RSPO3(e2) fusion |
| 20 | Reverse primer for the target sequence PTPRK(e1)-RSPO3(e2) fusion |
| 21 | Exon 2 of the human PTPRK gene (ENSE00003533687) |
| 22 | Forward primer for the target sequence PTPRK(e1/e2) WT control |
| 23 | Reverse primer for the target sequence PTPRK(e1/e2) WT control |
| 24 | Another reverse primer for the target sequence PTPRK(e1/e2) WT control |
| 25 | Exon 7 of the human PTPRK gene (ENSE00003783990) |
| 26 | Forward primer for the target sequence PTPRK(e7)-RSPO3(e2) fusion |
| 27 | Reverse primer for the target sequence PTPRK(e7)-RSPO3(e2) fusion |
| 28 | Exon 8 of the human PTPRK gene (ENSE00003657054) |
| 29 | Forward primer for the target sequence PTPRK(e7/e8) WT control |
| 30 | Reverse primer for the target sequence PTPRK(e7/e8) WT control |
| 31 | Human EIF3E gene (ENST00000220849.9) |
| 32 | Exon 1 of the human EIF3E gene (ENSE00002112612) |
| 33 | Human RSPO2 gene (ENST00000522333.1) |
| 34 | Exon 2 of the human RSPO2 gene (ENSE00001378581) |

-continued

Table of sequences of the sequence listing

| SEQ ID NO | Identity (if applicable; ascension number) |
|---|---|
| 35 | Forward primer for the target sequence EIF3E(e1)-RSPO2(e2) fusion |
| 36 | Another forward primer for the target sequence EIF3E(e1)-RSPO2(e2) fusion |
| 37 | Reverse primer for the target sequence EIF3E(e1)-RSPO2(e2) fusion |
| 38 | Exon 2 of the human EIF3E gene (ENSE00003610725) |
| 39 | Forward primer for the target sequence EIF3E(e1/e2) WT control |
| 40 | Reverse primer for the target sequence EIF3E(e1/e2) WT control |
| 41 | Exon 1 of the human RSPO2 gene (ENSE00002106748) |
| 42 | Forward primer for the target sequence RSPO2 (e1/e2) WT control |
| 43 | Another forward primer for the target sequence RSPO2 (e1/e2) WT control |
| 44 | Reverse primer for the target sequence RSPO2 (e1/e2) WT control |
| 45 | Another reverse primer for the target sequence RSPO2 (e1/e2) WT control |
| 46 | Probe for PTPRK(e1)-RSPO3(e2) fusion |
| 47 | Probe for PTPRK (e1/e2) wild-type control |
| 48 | Another probe for PTPRK (e1/e2) wild-type control |
| 49 | Probe for RSPO3 (e1/e2) wild-type control |
| 50 | Probe for the internal control |
| 51 | Probe for the PTPRK(e7)-RSPO3(e2) fusion |
| 52 | Probe for the PTPRK (e7/e8) wild-type control |
| 53 | Probe for the PTPRK(e13)-RSPO3(e2) fusion |
| 54 | Another probe for the PTPRK(e13)-RSPO3(e2) fusion |
| 55 | Probe for the PTPRK (e12-e14) wild-type control |
| 56 | Probe for the EIF3E(e1)-RSPO2(e2) fusion |
| 57 | Probe for the EIF3E(e1/e2) wild-type control |
| 58 | Probe for the RSPO2(e1/e2) wild-type control |
| 59 | Fusion A 1747: PTPRK(e1) + RSPO3(e2), 608: (5'-3') |
| 60 | Fusion A 1758: PTPRK, E1&2, 539: (5'-3') |
| 61 | Fusion A 1759: RSPO3, E1&2, 579: (5'-3') |
| 62 | Fusion B 1848: PTPRK(e7) + RSPO3(e2), 486: (5'-3') |
| 63 | Fusion B 1857: PTPRK(e7, e8), 597: (5'-3') |
| 64 | Fusion C 1846: PTPRK(e12, e13) + RSPO3(e2), 503: (5'-3') |
| 65 | Fusion C 1847: PTPRK(e12, e13, e14), 450:(5'-3') |
| 66 | Fusion D 1849: EIF3E(e1) + RSPO2(e2), 381: (5'-3') |
| 67 | Fusion D 1850: EIF3E(e1, e2), 233: (5'-3') |
| 68 | Fusion D 2029: RSPO2-004(e1, e2), 432: (5'-3') |
| 69 | internal control target sequence, 1148: IC sequence for IC77 PCR, 102 b |

SEQUENCE LISTING (69 sequences)

SEQ ID NO: 1 - DNA, 551896 bp, Artificial sequence
  Human PTPRK gene (ENST00000368226.8 )
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtgagtggccggggggcgtccccgacgaacgcctggagtcctgggctcacgaggggtgagccaggtccccgctagggctggggacaaggatcgtggggagctctctctgtccgggggtggggaacacagggtagagggagggctgtccccagagttcgtgccaggtgggacgcggggcacccattgttcctctccgaagcttgctcggggctcaggctggcacggtctagccggagagtgtggggacctgctggcttcggcgtctcgcgtggcctgcgccgggctagtggggaagagagaaagaaaaagtagttacgactcccgtgacggcactctgttgcttgtggtgcgggtttgttgctgtctgccacttgggtgtttaaacaaattccctgggaagccattgtcagaaatgtggagattcgaagggactgacctcggcgcgctttgccaggtgctttttgtcccgggaataacctcccctgactattgtctaactacttccccgtccctcccggagtccccttttctcctcccccagctctgggttgctcccgggcttgccctgtgcgctcgggcactgcttggagcatgttctgtgtgtgtgttggcggagccctgtaagatgtgttgaaatgcggttctaaggacccactctgagcgttcatgggcatcgaggtctgggcgcctggtggaggaagcctgactcgcgcgtgggagcccgctcctcgggcaaaaccaccgccaggctggccccgcgctccccggatccggcctggggctctggccccgcgctccccggatccggcctggggctggaagcggactgtaaatgtctgccttctgccggagaacccaaaaggagacaagtggagcgtctcgctgtagccctgggggttctcggtcaagccgctcagagaagtccgtgaaccctggctctcccggtcccgccctctgttcccctccagttttgttatccttcgtgtaggttggttgcttctttcgttctctcctctgggggctctgaagtttcaccaggtggacgctggggagcgggctcccgagcacttgtctacctcccgccagtcctgacaacttttctggccaacctacccagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactcaaattgttgttttctggagtaatcgtttatttcccttccattgctctcctacccccgccccatttagaactctgtaaagggagttaaacaacagattcaggtggcagcatgtgtcgtacattcaggcagagattatgaaatggcagcacgcagaggaaaagccctgtatataattgatgtacgcagagggtaacagctctatgcaaaaaataatccaatggtttaattgaattctttctggagtaagcattactgcatgcatttctgacatataatgcccgttagcattgaaaccgtgcttgatgtaactcattatatgcaggcaagttggagtgagtattgatttctgcacagtgtttgtcactgcacggagagcctacgcttgaaaaggcttgtagtttgttaattgaaagtttgaactctaccagttgcataattaaacttacatgtattcaagagttgcaactattaatgtctcaacagcgatggatatattttcagcagttagaaaactttttctctttttaaatgttatttaccctttaattaacaaataaatactacttttcctccagctgaatgtgaaaatgagcttttctgatacctggagtttagatacgtacaataaacaattgtgttcttagatatctagttctaagtactttaactaaatatgcctggcttttctttagtgacaaagcataacatttgacatgatgttgtatatttaattaatataatgtgcattcctaaaaagtacagtaatcacaggattgcatctcaagattttgccctttaggaatgtatgcccagaaatgaatgtcttttattcccagagtttaaagtcagattgtggatttgcctttctccacaaattataagtttgttttgtaaatacttccttttttttctggctaccataaatcatttgatattttattgtcataaaattctatggcagtcagatttgttgcagacatagattagagatgtattgaagattggaggtgtattccatattgctggtttttcttatattttactttaactagtgaacttttattccttttgagaaatttaaataaacccactttaaaagtccaagacaaattcatgttgagaatttaaaaatatctgaagtatgtctttcaaatcatactcattaagatcagtttactttccgatatcatgtggttcctaatgtagtaagcttcaaaagcaaattttgaaaggctgagcattgttgggactttgatgtgtcatatacttattcagttttctttgtttaaaccaaaaatgtaagagtgttttcattattgtgacttttttcttagcttttgcagttaaagtgtaaaactgctgcactgtgagcctctttaaaaccagaacgttctgtaaatcccaactcatacattctttcagtttcacctctcacttaaaatgacacccatgtcatatctgaggaaaccgaggcatagaagaataaagaagtattaaagtttattcactgggttgtatagctgtgatctcttgatataatgtaagaaagttttctgtagaaggacttagatgactgacgaaaccagatgcaggtaaggtgacttggaaactcagctttctcctctgtaaaatggggataataatacccaacttgacctttccacatgttttttatgattaaatgaagtaatttatgggaactagcactgtaaattgtaaagcactgtgcagctatctggggtgtaatcatcattaagtgccttagtctcagctttttactccttccaaattctctctccagtaagtgcaggctgttcaggatttgtgtgtgagtgtgtgtgtgcgcacgtgtgtgtgtgcatgtgtgtgtgtgttttcactcagccagtcattcatttaattattgtttaacatagttattgttaaacataaacatactagattggccagaccataattttgtcagcacaatgatcgattatccttaatttttttaacttacctcgtataaatccttacttgagttagacccatggaagagtcactattaacattcctggcatttctaactacagaaaaaaatatttttagtcagtttctttagctgtttgtttaactgttggttcaggttttcaactctgtgttgagaataatatgtagctttctagatgcagtcttatcaatgacctagagagggactattgtctctcttgtatgataggagcctggaaatacagctcgagatcctgctttgtctatagttcctgacatgtcaccctgttgatgtgcacttagaatgctgtaactcatctaagcagcacctgagcagtatctgactccttgttgtctctttaggtgagattaatttctcttatacttattacctgctaggaagatactttggagccagcttgctttaaggtttgcctgttagttttttttggttttgattggctaaatatccctcgatccctcaattcattaaaactccacgttctaatcactagcaatcatatgtagctggacatttccaggactgtttttttttctctctctagttctcttgcatctgactcttgattttcctaggtcgtgagatgtagttttgtgtctggcctacccagacggaaagaggagagtctggctgctgtttggacattggcatgtgtgctgctgacagctcttctctttgtgctcataaaagtgaatttcaaaaataaatcaacccctctgccactctgccccctcccacactccctcctactcttttctagcaaaaacagagccccacatatatatacacaagatcacagcccttttgtttttgccaaatatattttagtgctgtacatgtccttaagaactggaaatatgactcatccactaaccaaagctaatgccaacattcccaccaaatctcatatttctagcaatgatggtttgttacaggtttttctggcctttaaggtaatatttaattcatgtgataagattccatatagaaaaagtgtgttggctactaatatttttaaagtgcagtataccaggtctactcaaactggtattaaagacagtgaacatcatgctaaatagggatctgtgctgctcccatttcccctacttgcttttcatggagtgcaggaagagagatgctggaagattgagagcaggaagcatcaagaaagtttacagattgttcttaaagacaaaacaaagaacacagggattctgtgtgtgtgcacgtgtatgtgtgtgtgtgagtgtgtgtatgtgtttttgatcttttacttaatttttagaagaggaaaaaagtcctatggtatttttgacttgtttattgaaatcagcctttgcctttgcgcaaacacattttctagttctgtcaatgtaaaaatttccctctgtgtattcttctcagtctttacactttgatcatatgtatctggtctgtgttccttcttcaaatggtgtttctttttgcctaaaaaggttgtaattgcttttgaacatgacttgtttttttaatcaaaactcatgctgtttgtcatagtactgaaaaaaaaaagtacaagacatcaattcatgataggtcttaaaacagtatttgataacaaagtaagtgaataatacattaatcaggctattttttatttcaattgaagcaaaaagcaaacttgcatatccatgaactaatcttttaatgtcacagaacatttatttgttgctgtttctgaagtctttaagttcccttttataaatggggatagacaatttcagaaccacattgcttgatattttgagataagtgagataagttacatacaactatgccttggaaaactgaaaaaatgttatgatgtttgatatcagtgtgaactctgaatagtttgtaaacttcacactccacattagtgcaaatgtgttttgtgaaaatactcctaaagaaacgtagtttcacataaaaggtttttaaagtttcatgaagattctgttgtgggaagtatgtttattttccttttgtattcttgtgggaattcttttgatctgtatttaatattttaataatgaaaactaagtgtatgtaattttaaaacttagtttcgtgaggttttttttagattgttgaggttctgggaaaacactgggcctgggatctaaggatcacattgatcctctcgtggaacattgccatttccccacttaactctggttgaaatttttggcattctccttcgtgtgttgataatccataaaaattacaagtggcttattttgtcacttacagttgttttaggatcaaattaagttgtcctaaatggaataatccgtgtttccacttgatatgattattgagctctgataatgaaaatgatgaacagggcagtgctggctgaatcctccaacaggtgtcattctaggaattgttttaataaggggaattcagaaacaaggcaaaataaaatagtgcgtagtggagttattgtttgtatttattttgttgggaaatgtgaaagatgtaagtatgtagtcctctgtgtgaatacacacacacacacacacacacacacacacatcttaacaatgctaggacttagttgtagaaacatttaggttagaaagaaggtaagggcatctagagatggtatcaaaactccatacttaacatttttggaaagagtagtgaaaatagatcactactttatttcatagatgtagaaacaagtggaaaataagctgtatataatctatactgtatactatactatactgttatacttttaaggataaaataataaatctttctccagattggtatctattaatataaacccttcccagtgcagcctgttccttaaccagctgctcataggccgattctccaagcgctgttcaaggcagcagctgaccagccacagaaattcccttaatccgtgttggatagtggaggtgacctagcagctgcttaagtgacagactggcaacagttccttgatgtgatttttcttaggtcattcagtaaattcaagagtagagaggaaggctttctagggtcctcactacccacccagggattgatgactgattgcttcatggtcattggattcctcactgcaaggtgtcctgggattttgtggttcatggaccaatataattagcatcatctggaaatttgtgatgatctgtgatcatcagagtcaccccagatctactgaatcagaatctgcattttgatgaaatccccaggtgatttgatggaacatttaattctgggaaacactgctctaggacaaagaaagctcagtttaaaaagattgtcacatgaactttaccatagaatttcaagaatattgcaaaaggattaatgataacctgaaatacatttccttggatttatatttctttttcctttctttttctttttctttatttctttctttctttctttctttttttttttttggagatggagtcttgccctgtcacccaagctggagtgcagtggcacgatctcggctcactgaaacttctgcctcctgggttcaagagattctcctgcttcaggcttccaagtagctgggattacaggtgcgccaccatgcccagctaatttttgtatttttagtcaagatggggttttaccatgttgcccaggctggtcacgaactcctgagctgaagtgatattcctgttttagccttctaaaatgctgggattacaggtgtgagccaccatgcccggcccctggagtatatttctgatcaatatttacttgattattatttaatattccagacacatcaaaacaacagtactatacaagctttttaaaagaatgctcagatgactttgaaaaaaaatattttcataagagactaaaagtaagactagttttggttatgaatattttgtataagaatatttaaagataaacatactcttcaaggaaccaaacatgctatatgcaaatcatttttagcataatgttatgttgatacaggaaatactattccctctgacattactagtagcagtctcttgctttataattctctttttcatctaagtgtaatttaagatctttgtagtaaggagctcatttataggacagtcaaatttaatgaatgggagttggtaggtagaatgcattaaatataactggtgttctttttattatcttttgtgctcatatttaagaacagagattcttgtcagttttctcaagagaaaaattatgatgtaatagacagtgtacactattcatgtcaaaacacaattttacttgcattttatagcttgctttagcattcttttagaaaatgaattttcccagaagacctaattgccttcttattaatgagcctgtaagtgttttttgttatccatttactattctaaatgtgtctacttgtgctagctgtttcaacagtgttgtctctgattaaatcacaactgctatatttgtttttgccattcactagtgattcagaaaatattggcataatgacgtggttatggcagagactaataaaaaacaagaagtaaaaattaatgttcacccattacagttggctgtatcatgagatcagaagctggagtttgggataatagcaacgttctctatatttttgatactgtaaataaaagtctgcataacctatattgtcttaaatataaaatatataatttattgaattaatgaactgtaaatcagtgtatttccatatgtacttaatttagacactaatgtttaaagaaagatttaataggagactgatcactgttagaggagaagtagtggtggagagactctgagagggcactttcgtatatcttcaagaacttcacagttactttttctagtttgactccaaattctggaacttgtcttttttactagtactgcttttattcttatgagcaataattaggttcatttattttcttatatgttggagaagagagcttttcctaaagcaattgcaaaaataacaatatgagctgtaatttactgagagcccatgacctgctagggcctgtgatcagtgttttacataattttaaatcctcacaatatcctttaagatgaggatcatctccattttacaaactaaggcctcgaggggttaagtaataacttgtcccaagtggctatatgagtcactggtagagtcaagattcgttaatgaatgtacacaaatgtttaaagattagacatttctttggttgcatcttggcagaaaatgtaacccagactggttgcaacaaaaggtgaatttatttgtctctcctaactacagttcaggtggagcttgatttagaagttgacgtaattccactgagacatgatgtttctctgcctgcttagtttagttctagggtattccaggagcttcttaggctccatatagaggcacgatggctgtggcagctcccaccgaacaagatcccaggttcaagtcccttaaggaaatgtgaattatctgctggttgcacctgataaggctctaaggtttacagtgcttgaatccactgatcttgtttccaaccattgaatctaaggctctgactgaggggaagttagtgtgctgattggcttggcccagggtttgtaatctttctaatggggaagaaagaagatgggagatgatggggaagagacagtaggatcagattgttctctgttgtggaccactaggtgatctctaagtgggaaagcgtggaagagaaagagaggaaagaggcaatttgtgtctggcaggcttgtatacatttacagatcacctgtttttaatctgagagtgtttatttattggctttccctttaaggactactttaaagcatgaatttatattatttccattattttattttccttgtctcagtattgaattagtctaacattaaaaatttgtagaatttggtgttaaaaaagatcttagaaattaatgaccccttcatttgacgtaagttgcccaaagtcatacaggtaggaagaacttgagctcaaattaaagattttaatgtataggttagtgttcttactatatatgtatcatatattaatgtatactatatatatatcattttccttaacagtaatctatataattattatttaagattaaaaaatttttggcttgtattccaaatttctgaaacaatatttccaaatataaacctgacttagtgattggatttgattagaatagtagtctgcatataaggtgataatatgtctgtgaatgcaagagactatcttagataactgcttggttttcagatatcatgacagaatttatacatgtatgcatgtataggtgtttgcatgtatgcatttatttatttttaatagaaagcaaagggtaaagtaagctgtggtaaatgatattgacacagacaaaacctactaactctactatttttgaaaacctcaagagatgatggtgattttatttttaattttgatcctctaacctctgctgcctaaatttattatgtatatctgagcaacatgggatattaggaagagttgctataagaaatatcttggggtactgaataatgaataaaatgtagagaagtagcagctgtttgcctagctacctcctctcctaatgagagatttacccaggctgtcttaatcacatgttagtgctagtggatttgactgaggaccatggctgtgccagttgaggccaggggatagtctccaggcactttaatggtccgtaatggaccttcaatggccagggcagctggcctggcacataggggtgtagacagtggttgaggaggaaggtttactgacttcatcatgcttccctttgtcactggaggcttgttttcgtacacttttgtctattatcataaataacttatgataataacttatgactctttttctgtcttatttatgtccttatgtgatgactgtcagtcctaaatgatgaagtttgtaataatttgccctaaccacctggtcagttggagcagattgctatctggtgttgactcattatgcccctttatctaaaccaacacttaaatgctcaggaaatatatgaatgaggtgaaggggctggcagcaacctacctcagaaccaatgcctttggagatctatgcaggaggctgtttaatgcacagagcactggccttgctacaggaggacttatgttccagtcttaagctctgtcactttctgaaatttgggagcagtcctttctgcttgatctttcatttctttatcaccaaaatgagaatattacaatgaagaatgactttaatgtcttgtctagtctactgaaccagacacttttaaggtgaaatgaataatatatgtgaaagtagttttatatttgtaaactaccataaaaatgtaaattttgttaggaatagaaactttgacaataaggaaagtattgctgaaggcacaaaaagtgtgtatgctgaagaagggaaatgaaaacaataaataaatgcttcatatatttgcatgtttaagtgatacattgcctctcaatgttggggaaagtggtataataaagaagaatgagcatggttcttgtgaataatgggtgattctgcaatcatgtatcataaagagcagtccccccaacttttttcacatatatgtatttcctatgtatgtataaataaactttaatgctaccaggtagttcactagccctcccatatctctgggggatacattccaaggtgcccggtagacgtctgaaactcgtatggaacccacccttaaatatactataccatgttgtttcaatctgataatggaaatggctactgagtgactaacaggcaagtgggctgtacaatatggacacactagacaaagggatgattcatgtcccgggtaggacggagtgagacagcatgtgatttcatcacgccactcagaagggtgtgtaatttaaaagctgtttatttatgaaattttttcgttttcttttcttttcttttcttttttttttttgagatggagtttcgcacttattgctcaggctggagtgcagtggcatgatcttggctcaccgcaacctccgcctcctgggttcaagcgattctcctgcctcagcatcccaagtagctgggattacaggcacctgcctccaccatgcccggctatttttttgtgtttttagtagaggcgggattttgccatgttggccaggctggtcttgaactcctgacctcaggtgacctgccgcctcagcctcccaaagtgcgggattacaggtgtgagccacagagccctgcttgaaatttttcatttaatatttttggaccacagttggccaagggcaactgaaaccacagaaagtgaaactgtgggtaagggggtcctactgtatttgtatttcctccagatattcaatatagattatgtgattataaaataagttattaaagaaatgtaaatgtgttttaagtacttatatatatcatatatagaaagttgtgtgtatacttttttccttttaaaaattttcgtgataagctagaacatgctcttgccatctaagctgttctgcctggtttttaagagcatgatcctgatgaggtttatatcctttcatttattctttcactccatgaatctttgagcaccttactatgtgcccatgctgtgccaggttttgggtatgctggcaagtaagccagcagtgacttgtcccagtgcctgtgcagcatttataatgttaatgactattaaggcatggtaatatttgcatcgctgcccacatctagtgattcacaagtgaagcttggggctttgttggtaactgaccatatattttataactgaccatactcctgagatgtggcaagtgtcaaagctctgtctgtcttacagtttgctgattcacttcagaacttgcctaggataattccagtctatcagtagtctttccatagtctcaaaactacccaaacaagtaaaagcctaccgaaaaagaattacaaacacattgccacaatgatagtaaaattccgccaagtggaatttcccaaaacttgagtaatccgaaatgtaaacaaagtcaggcagaggagagagcacatttgttttctggaggtttgctgtcactaactctccctctggaagcaggatcaagaagattggtggacagcctcttagactacagtgtatgtcaatgtgcatttacaacctgaatattcacatgcataatccctggttgtttggctgcagaatcctgtttgctctgacctgcagctgcttatgaactgcctctcttgcctggactttgatcagccctctctctgctattgcttctgtagcccattgccctgtctagtgggcagccacaagagagggagaccagtggctggcagagtcctatcagccaggaatgagggtgggctgtgaccatcacctaattgccctggcacctgcatcccataaggcactgtttggtcattcattatgaaggggacaacagtagttatttaagtacactcacggtcttaccaggaaatggggattttgaacttctgtcttaaaagaggcccacatggcctctagagtgggcctctagtgtgaattaaggagagaaaagcaattttggagaagtgtaaatttttcctaagccaaattaaagttactagattacatatacccaaggttcaaaaatagaaatttaaaaaactgttttttgttagttgagtcactgatattttatgcccattttgtgtttaagcaaaagaatacttatcaaatgctgatctccacacatagtatagagcatagtgtttaagagtgcggacattggaacttgactgcttgagtgggaatatacattccaacatgtttttactacatgatctgaccactttccttcagtttccacatattcaaaatgggaaagtacccattccagatgtaggttttgagaaatattgagttacagtgcttaaatgagtgcctggcacactaataaaatttgtccattttagttattattgttaatgaaattgccagtgtttgcagaatatctaatctcatgctgttatctcttaaaatctctaactacattatcttttactttaaaataaaaccaccagagaataaataataggatgcctgaagtaaatcagctcaatatgctgattaacaaagaccacaagcatcactttatagaatataatccagtgtttatgaaaacaagaagcaaacttattctttttttatgttagaggttacagtgacttataataatttttttttttttttttttttttgagacagagttttactctgtcaaccagactggaatgcagtggtgtgaacatagctctctgtggcctcaacctcctgggctcaagcaaaactcctgcctcagccttcagagttgctgggaccacaggtgtgcgccaccatacctggctaatttttaaaaatttttttgtagagatcagggtcttgccatgtataaaaacctacccaacatctttggaaaatgcatttaaaattctctaggtaggttgagggaggtgggaagtttttggcctacaaagaattgcttaccttctagaacgatttaatctcagatgataaaatatgaaaattctaaattgggaataaggttaaaataagaattgaccagaaagtggaggaatgaaatctctgccactccaagcagtgcccatcccagtaagtattatgtcctatctgggagtagcactcagatttagaatgagagaattagaattaatcaacaagataagagggatctctttaatgcctaagaatgttggtatattgtttccccaatggttatagaatgagaaaggaatatcactattgcttctgtttgcatttgacacatatgctaaacaaatgcactggcttttagaacgtgtttatgaattctatataacatttttctttttctttttggaggttgcctagctatttaattttccttagttcacaaaacaatgaggtagtttcaaatctatttgaaccccaagactttttcaagctgctgttctctgggtaaagccacttagtcctggcacatggtggaaaggtctggctaaagttttgacaattattagctcatttgcagagttgctctttgacctgtcaacacagaggaaagcttttctaagctgtgagaaggattttatgttagactcgagctttagatttcttttatttttccaactttttaacactatcttttctagctttaattgacacaaacttctcttttccttgtgtaacacttgtgcactccagatgttagaaatccctgttaactttcttaccggagaagctctttgcactgcaggcttgaatgtcactgagataatgtccttacaatatttgcaactttgtgttctgactggatgctcctactaacctaggtcttctttgtgattgcggtggcagcagctgtcttcataaactcatcttcatttattttttattttatgtgtgtatttattttttttgagacagagtttcgctcttgttgcccaggctggagtgcaatggcacgatctcagctcactgcaacctccgcctcccaggttcaagcgattctcctgcctcagcctcctgagtagctgggatagcaggcatgtgccaccacgcatggctaattttctatttttagtagagatggggtttcttcctgttggtcaggcctgtagtcccagctactcaagaggctgaggcaggagaatcgcatgaacccgggaggcagaagttgcagcgagccgagatttcgccactgcactccagcctggtgacagagtgagactccgtctcaaaaaaaaaaaaaaacaagtaaatttcttaagttgttatcattttggtatactgtttgaccagattcagtctcaataaaaggagcattaacaaaacttcaaaacttctatggcacatctaaatttaaatatgaaacagttctaaaagcagggatgtatacttgcttgtcctggaccccagaatcgtgactcacttattatttggaaagcagactgctacatattttggtcacaataatacctaaaggatactgaatcagaaaatgagtaactgaaaatgggagatctctataatgaaaacactagatagtagtatacttaaatatgatagtgtacatgagaaaccataaattttaaccagtgtgattcaggctctggctttcaatctatttgcactagggtatcggacaaacccacaaccaggaaaggtgagcgcagatattgccagaagaacccaggtgctctgattgcttactccttaggcaacgtttcagattttgcaaggtacattgtgccctttcccggctaattcttatcaggaatgcacatcccagttgaagcctgctaattgctctgagggctgttgtttttacctttaatttaggttcaggagtctgtagggcaatcctttgaagttcttagttacttactgttcactgaagtatccacttgagatctttcctggactctctccacagtttgttcacaatttggcacaccattggctgaaagtactctatccttgctccttgctcattgacagttatactacaggctgcttccagttgccaacacattttagaaaagcatataattttattaagagtttttcctgttgctttcacatgtagtcaagtaaagggcaggggacagagaaggggcaggatgtcatgtcagcatttacctttccagaggctaatgctttgaaagaataagaggggtccttttaggtcaagactcttattgttcttgtcacctgatttgttggcattgcagttacatcacgtgttgtcttttatgtgagcaatgacaaaaaggatatatctattctgtacatttttatcaaatatgatatccttcaaagcttgttaaaacaggtgatatcagtctgtgttcttaatatggtcttgttggcaacaccttattggggcgggaaccattgatttgtgcatttccaggattgattactatccctaataaagttagtctggtaggcaaaatagcaagaccttatctctacacacacacacacacacacacacacacacacacacacacacaataataaccaggcatagtggtgcatgcttttagtcccagctattttggaggctgaggctggaggattgcttgagctcagtagttaaaggctgcagtgagtggtgattgggcactgcactctagcttgggcaacagagcaagaccttgtctctaaaacaaaatacataaagttaggctggtgagctagggtctcttcatttaacaaaatatgtatgacagagtttatctgatttctttcatgttagtttggttaagttaatcaaatagtaaatgcatgttcattctgtgccaggcagtgtatatagcacagagggcaaaatgatttagttgactaagtccctgcacttaatgaccttacagactatttagaagatctagaaataagtaagatataattaagagtgggaggtacaaaaagtgccatcaggacgtggagaaagtacagtcactcactcctgggtgattagttaagtttctcggatcaggccatcaattggcaaaatccttatgaatgggcacaaaatgtacttgggaaaatgaggaagtaatagcgatggtggtaaatgtttaataatcagctctcaagccaaaaagttcaggttttatttgtttgttttgagatggagtctcgctctgttgcctaggctggagtgcagtggcgcgatctcggctcactgcaacctctgcctcctggcttcaagtgattctcctgcctcatcctcctgagtagctgagattacaggcatatgccatacgcccggctaatttttgtatttttagtagaggcgggggtttcaccacgttggccaggctggtctcgaactcctgacctcgtgatctgcctgccttggactcccaaagtgctgagattacagatgtgagccaccatgcctggccaaagttcaggttttagcacttgccagtttccatggtataaatactaccaccatggctgaattcaaaggaccaatgtgacatcactgaacacaaaattaggaagagatgcatagtaacacacccttatttagtacttccaccatacagatacaagagaagtaaatatcctgcaaatataattaatagtaaaataattagaaagtgataagttttgatttattacctctgtttttaatataatttatttagctgtaagtttatataatttaattttaaataatggttgtgactaataactggcccacaaaattcctgaacattttagcaactgactttcaggagctggtataggctggtttcagcccagcccactactccatgccttataatttggcatatgggtgtgaggaatccagtgagataatcctctttaattatgggatctttctataacactttcctaattgaacagtttagtgtaagaaaacctggtccattttgaaactccctggcaggggtttagttatcaagaaactttaggttcgttgacacaaaatgttgatgtcagaaggctttggtgcatccactgtggagcttaatctcaggaataaatccccaagaagaagactgtttttctgtttaactcaagtttccccactatacaggattgactctctttggtctcaggtgctgatatgactattcaagctctctttaagtcctgttaacttagagcactgctaggactatataaaaggtaaacttttcaatgtctttgaactatggacatttttcatgctaaacaccatctttcccaaatactacacagtaggtagtgggttttcagtaaatgtagcttgtaaattactacatcatctttgtactaacaaacctcccgtggctcacaagagcacccaatatttaagttattcagaaatattggaagaatcaacatgtctgtaaaagtaggtagattttcatccaattctgctatacattgccactttgatggattttaattttgggtgtatgtatgtgaaattgttaacatctacaaaatatacattattaaatataaagcatgttttttcatcttaatactgcatttgggctttgatttaatggtcttttatcattattttctactgaattatcagttacttttaagcagttattactatttgttagctaaagttacttttgattatttcacttgagttttaaaattctttcattatttaatctctatcagtgttagaaaagtggaatgttgttttaacatatgctcttataatatttgtttatataggacaaaaatatttcatgttccaaaaaatgtcatgtaagattaatgtagcgctaaatggaaattcctgtgctccacatgcctttgttaggctccgcccacaaaaaacctagtgtctaaaactaagatattcacattttaaggcatattgtaagaaagttcttgaaattggcagattgtgaatatgttgtatatgtattttttcccttttaatgggaagggtgtgtgtgtgtgtgtgtgtgtgtgtgatttgagtttagtaatatatgacaaagtgctgacagtccccaagtgacttatgacttattttgggaaaatggattttctccatatgatttctctttgtatatcttatataaaatcttttatcttgtagcaggaaaaaaatttactttcccttatatatgaacaatttcaagaatttggaagcattccaaactttacagtttaaacatagatttcaggctgggcacagtggctcatgcctgtaatccagcactttggcaggctgaggcagatggatcatttgaggtcaggagtttgagaccagcctggtcaacgtggtgaaaccctgtctctattaaaaatacaaaaattagctgggtgtggttgcacacacctgtagtcccagcctacctgggaggctgaggcaggaggattgcttgagcccaggaggtggaggttgcaataagtcgagattatgccactgcacttagcccgggctagtcccagcctacctgggaggcaggaggattgcttgagcccaggaggcggaggttgtagtgagctgagattatgccactgcacttagcccgggcaacagagtatagatttcataataaagattcctcagactgtgcaaaacaaaatgtagatttttaactcttctcagttagtactctttctccttgaggaaaccaagtgggagaagacatagagacaaataatattcagaattaataaaggtgtagcactaagtcgattgtttcctgtacttaaatggttatataataggaaaaagacatatgttcatataaactctcagggatttatttttaaagagcaatctcttctgtgtgacctgtgatcagtagacgttaaactcaatctcttacctttatgcctataatactttaacaattaattgatattcagagtgatggctgaattagctaagcataatcaaaaatgtaattatgctgggtaaattgtaattcataaggctggaaagcttaccagtagtggccacagtgattgaaatgagactcccccccccaaattttcagttaatcacatgattgtattaactaggatgacccatttttagagcatctgtttctgacaacttctaatttgtattactctctatttcaacattctgtttattcagcagggcctgataaagatttttagttcatgtctcactatatttagccactccttcactgcagcctgatgacataatgacaacaatacatgagcatcaggattttacctgcctctgcatcagaaactgaagccattggtgtatgtttctctgggccatttacatgtcttgcctgagtatttcagaggtaaacattgtatcccttttgagtgttttgagtccaccaacctatagggacataactttaaaaattattttcaataactaacattttagtgtttactggtcctagcattgagctaagtatcagctcattattttcaaattgtatgtaaccacccatttggtgggtaccgaattcaattcagtaggtagcaaccagcttaaggaagaaaaccagaccaaccatgaaatagaatataacaaaaacaataacaaaggtaatcatacattttgtagaggaagagagaagtattgtttcatgaaactttggttttaatggaatagatttatgtatccttatatgtctgtgtactgagtcacaatgcaaaaagaatttctaactgtgggtctggccaaaaatatgggaaagttactatacttctctcatacaatgtttgctataaatcctattcacacaactttataagctccaagttttttctcttaactattatgtcgtggcacttcctggtacagtgcaaagagcatagagtttgcgtaatttggtaaatgagtaatttaacttatatagcctgtttccttatcctcaattcgtgtataatttctggatatttacagggttgtgagaatcaaactgggtaatttatgttggatattcttttccaaattgagctacacatatgtaagttactatgattgtaatgccttgccctttggcccttcaaatactaattgactactgggtttgacttaggaagactggattgtcttttaaaatatttttcgaacctgaagatttacagttcagtgttttcacttgtagagatcagtcctgttgagtactttttacacagtcttttgtttcttctttatgacaggatgttgtgaataaagctaaggttttttttttatttacttttcctattttggtattactcttgacaaaagcaatggaaggcaaatgtactttggacatacctgtatgaactcattattcacatttgtcttcaaataaagctgcattttgattttaaaacaaaataacactatgtaaataaaactcgatttaaaatttacgttgaaatacctattgtgatactcaatggaacattgaaataattttgaccaataaaaatatatccaagacttaacaacaacaaaggaataaaaaagatacacaaaacctccaatcaactgtaaaacttgtgagtagagatatttcagtaattgaaaatagctagcagagtagctgtccgctgcctgtcttctctctctctgccattcattctatttatctatctatgtgggtatccagctgaattttttgtcaagatatatgtttttattccatatttattctgtggcctaatccaaaatataatcataaaaatatatattttacattttatgtatcagtgtggcataaccttataattcagtatatatcctgaagactttgagttatgcacattgtcatacttagacatagttctcaacctttagaggatcagacagttatctggacagaggagcattgatgccactgttctccagcattcccttagcctcatcttgctaaaagcagaagaggatattgggatgcaaataaagtagaggaagggctctttgccaagtgctgtttattgaactgagtaaacgtctcccccatgggttggagggagctggttcgtttaagtgggcaagaaaagccagtattcttccaagtaatgaggtttcttaaataaatattccaaatgtagattctctgggctgcatcaacaaggggcaagcctgaaaagtcccctcagtatccaggagcccaggttgagaagggttctgttttgaaactggaaactgtccgtagtttggatgggagaatgcttggaatggaagctaggctgtgatttgtctttttaacattcttgacagaaaaagggtgttaaggaagcaggatgactacagtttcaggggatttatttacagctcctaagaaaattaattgtttttttgcttttgtttttgtttttttttacaactcagacaaacattatgctaatagaaaagtatctaaatctactcatgagaaaaattctttaaggatgcatattagtcaacctgttcttaaaactacttattgttaaaaatacttcgtaatatacacaacatattcttttaaaatgttctacagttcagattttaaagtgattcgtagtcatctcaccccacctccagttaatgagattttactgtttatttgttagctacatctaatagaaaggaaaaaaaaaaacaacctttttgataggtgataattacttaaaaatttggatccaaattaagagaacagagctcatcaaaatatggatgtattaacactggaatgtataataatgggaaagaaggtataagaatgacagagtgagaaattttaaaagaggggaaataggatgaattcaatcaaaacaaggaagccaaggtgtttaaatgggtgaccctctcactttgatgtttatctgattgaaatttgacattttctatttactcatttcaaaccaagataaaaatctcaagtatttaaagcaacctattttctgtctagtttgtgttcaaattattattattattaaagacagggtctccctatgttgcccaggatggtctcaaactcctgggctcaagggatcgccctgcctcagcctccagagtagctggtattacaggtgtgaaccactgagctcagcataaaatggttattttttaagtatatatagccaggcataattaaattaaatatagtttaaaagtgagtttaatgttatttttttcctcctcttcctgggatcataaaatgattaatgttaaaattagtgttctgctactgactggaacatacatgtttattatttccctctaatgtgaacacttgctggtagtatagaatatagtcatcttcaattccgacagttgacataaggcaattttataagtgattaatcacatactattgtgcatgtaggagggttttggcttagagttattttggtgtactttttggatgttacgatttttattttataagtaaactcatgtttgttacctgtaatgttttactgattccagaacaacttggccttctttggtttattgtaatgccaagcacaattatattttgagtaagattttgtgagaaaaattatagtcttcttggtttataaataattgtgttatgagagtaattctaaaagccacacctgaaaatgtcacattacaacatcattagtttattataccttgtgtaacacttttgcttttcataaaccaagaagcaattagagttagattatacaatatttgtttagaagataataaatcttacaggatgctaataatttaaaaagctgcatatgttgttactaatgatcaaactgaaagaaattatatgatttcaaacatgactgtctttctgatcgttcaggacaggaccatgtaaggataacatctggacctgatctcacatctcaaggtcttaaagttgtcacttcacttaggtttaatattttatcttaaaaatggttattcatcaaatattcattaaatgctaaccatatttacaacattctgcgaggaaccatagggttacaaagtatatgacaaattccttagatataatatataataatcagaggtggaattttacaattattattctctattctctactttactactggactgggttttaggactagcccccatccctgctctacttttctgccttaagatttagggaaatgttttttctgataatcacattgctggaatctaagatgggcttcctcatcaagtttgctttttttcttgagattttgaaagacactctcagtcttcagctgtatattgagcaccttcactgtggcatgctttagggactgaggtcatagtccttttcattgtggacttttcatcctggacttttacagtctggggtagatggatgtgaaacatatacttgtcaatatgtaatcctaagtttggaaagtccagaaaaaaatatagggggtttagaagaatgtgtcttacccaaggagtgcacaggaattttgacattaggaaagctaggcaggagatacaagcaaagagtcccacctgtgtgaagacatggagactggagagaatgcggtgcattggagagaatgcagtgcattgcagcaactgagagaagcccactcactatggctggggaagaggcgtgaaggagagtctggtgagagtggccaaagcttcaggtaaaagccagagcatgcaggaccttataactaacgatgacgacttaaaggaaaagacatgatcaaattttcataagtatcgccctcagtatagtgtgaaaaagggtttggaggggccacgtggattttggtgagaccagttaggaggacattgttgcagtctaagtgactgtagggtgagagaagtgtacaggtaaaggtattttgaaggtgggagtgatggagcatgctagtagatttgtggggacttagagagagggaaggatgagagatgctgcctgagtatttggtttgaactgtaacatttaaggaggatttttttttttaggctcttgcctccacgaggatttaaaaacaaatttgcatattaccttttccttacagttcacataattccttttttaggcaacatggctatatattcttttatcttttccctgaaattgcgtctcttattaagatttaaagtatatatctatgtacatatgcatttgtttaaaatgtagtcatttaaaattcagttctaaacaactgggtccttaccccaggcacctttctatattgattctcctttaacttccttgagtgataagctttgctatttttgaagttctttgcctattcactttctcttctttagactgtgtatgaatggatagatacacacactcacccacacagtttgttttaaattgcacagagttgatgtataataaaatatgaagaaaggaagaaatatttttaaaattcttatattttctttagtggtttgtcttagaaaatgaacacataccggagagttgagaactgagatttttgtttattttatttatttattttttgtgagaatagcaaaggctttacaatgtgactgcttactaatgtcagaaaaatagcaattcagctcttactttctcccctatactttcagggcgttatgacagttttaatgtgagttgtaaaatgtagggaggtatactctaattctctttcacacacataaatcaagtttcaggctcttttggaaatgtttactagaaaaaacatcatgggcagattttaaaatgcttttggattgcatgacggcgtggtgccacttccattgaagtgttgtaatattttattttccttcccaaagcgtcaagataaatcctgtaaacattttttctccttttgttgttttggttgtactattgtgtttggctctagccttttgcccccagggaaacaaaagtgtttttttttaactgcagtgctcccgctgagtactccagctgttgggcagcagtttcaaagttgttccctatttacacactgcaagtctggcggatcacaaagcttcctacatcttatctgaaacacaatatactaatttcagggatatatttagaaggaaaattgttgtcaaaatttactataatgtagcttattttatcttttaaatttaaaatctactaaatcattatatctttaaaaaatggtgatggtgaatgtcagcataacacgtaatcttatcgaaacaattaaaatttatcaattagcaggttcaagtaactacacttttttttttttttttttttttaagatacagggtcttgctacattacccaggctggagtgcggtggctgttcacagttgaggtcatggctcattgcagcctcaaactcctgggctcaagccatcctcctgcctcagctgcccaggtagttggaccacagacacctgttctagtaactactgtttgtctatatttaacgttaaccaatgtggtaaaccactagtgtgtaccagcactatgttaggctttgtttaggttttgccctctaggagcttcagtctgtttggagaaatggacatgtagataaatgttataactcacgtagaaatgaagtgcttagagaaggcagatgacagagttactggctgtatctggagaagttggataaagcatcatagatgaggggacagttacctttggagtttccagatgaagagatggaggaaaagtgccttgatgacaccaagtcacccattgtgcttgtttaccatgtggttaaaataaagcatttgcatttggtgatttctaaactctcttctagttctatgaattgaccacagtataagtatagttgtttctgtgtgtgtgtgtgtgtgtgtgtgtgtgtgtgtgtgtgtgtgtgtgtgtgtgtgtagggggcgggaggtactttttttttttttttgagacggagtctcgctctttcacccagctggagcgcagtggcacgatctcggctcactgcaagctctgcctcccgggttcacgccattctcctgcctcagcctcccaagcagctgggactacaggcgcctgccaccatgcccagctaattttttgtatttttagtagagacagggtttcactgtgttagccaggatggtcttgatctcctgacctcgtgatcagcccaccttggcctcccaaagtgctgggattgcaggcgtgagccaccgcgcccagccagttagcggggggtacattgactgggcttgagatgttcgtatgtaataaatttttaaaaattgcagttttaatttccagtttttagtgaattttggtcaatagaatttgctcttaggaaaaagtaaaggaggtgaatgctggctttcttttgcaatagaaacagccaactcactcattcatttaacatatattgttgagtgcctaccatgtgccagatattgttagagagcaataaaaacacatattccggcttctaaaatacttacattttggtggcacatgggacaccacactctggattgggggaaaatttggggtatgggttgccacaaaaatgagcaaacatcagtgtctcctgccctttccaaaaagcacaagggggctatccaagagaagggagaaagcaggtctaggcttggaaaggataggtggaaagtgtggcactagcaaggggtttttggaaggcaagggtttccatatgcaaagattgggagatggagtatttcagctgaagagaaaacttaagactattttcaggccaaacagtccaacttgaagagtgggttatattcaatagagtagtaggagatgaattagatactgagcatgaaaataacagctatgaacttgtcctcatgccaggtgctgcggcaagtgtatttacttattaaatacttcaaaatcccgtaaaataaatattattgtgtctccatgttacagcttctcttggggccatatgagtaataaaagacaaataagtttcaagctcaggtctgtctgatatagaaatacttgatctcaaccaccataatatattggaattttcatttttggatagttaggctacaaggttctcttgaaaattttgagtaggcagttgcttaaatatgtacaatgtaacagtatgatatatcccataatagtgttagatttggggtattctgggaacatgctgaagaggcaaactactcagttgggggtggatggatggaatttgcctaggaggggatatcagcattgagaccaaagacatagagcagttatcagagccaatgaggagggttttcttgatagagaaggcagcatgtgaagggcccagaagtacggtactaggaactgctactggtatctttgaagattctgtaatagagatgaatgtggcaatttgttgggactagatcatgaaacccttgggtgttatgcaagggaatgatgactttatcttggaggcaacctgatgatatggaagagttttaggcagataggcaggggagtgataggatcagacttccacaattagaagattatgttaaattcatttaaacaaatgtgaacagtagtgaatcaattcccaggggaagtttcattgccaagtattcttcctgccgtgaagattagcctgttagttaccaagccgctttcgttttcagtgtctgtgcttgtggtcggtaacttttgctgctgttgttctgctgctgtctgccattccattcgccatctatcacgcacacagaaccctggccaggatcatgaagggcgattgaaaaggtaacaagagaaaaaaaatgatagattaatgtaagcctgatgtttgttttagtggcagattttggtgttcacatgagtgcctgagcctgtctaaattaatctcatattctcaccacagtcttctagcttgagaattgactgcaggtaaaaataattggaaattattggtgtagccgaaactgcattacagctgccaagtgtggatacaccggagccaggctgcttttgtctgcttcctcataaacattctttccgcattctttatcagcacataatcctgagacacaaaaagcctttgtgtcccactgggaatgtgagaaaatcaaagctatctattggttttgctcctgttaggaaccactaacatttctatattaaccacccatgttttgaattgagatagatgttatcagcaagatgtgtcctccatttatccccaaagatatcactgtcccaatacaagaaatcttaaagacagactgcaaatgtctgttttcatccacttgatgctgtgatttgtggatacttgttagacatgtgaatttaatggggcttagcctaatagtaagcatttatatagaacttcccatgagccaggcacttgtatagtaatacatctaatcatcaccacagtcatgtgaggtagctattattgttttatactgtttgttatgcactgaattgtattccccaaaattcatatgttgaagccctaacccccaatgtgattgtatttggaggtagggactttaaagaggtcattaaggttaaatgatgtcataagagtgggccctaatctactatgactgatgtccttataaaaagaggaagagactccaagaatgtgtgttcacagaaatgaagacagaagaccagaaggtggctatccagaaatcaaggagagtcctcaggagaaaccagccttattggtatcttgatcttggactttcagcctctggaactatgagaaaattaattaattatttaagccttcaagtctgtggtattttgctatgttggccctagtatactaatacatacacattttgctgtgtgggaaaatgaaggcacagagaggttgagcgactgccccaaggtcacatggctagaaaatgacagaattaggatttacacatggggagtgtgattgtggaatcaatgctgttaatcaccatgctgtactgcttctcatgaagacagaacttcccagtattggggcctgggcggtatgaccatattctgcctctggcatctttcctccccttattttctgtacccagccctctgcgttctagtgtataatactcatggactgttcaccttgggctatactatgtaggaatgatgcatctgcagaatcctttactctcgtcatggttggcagtttgctctggtttgagcaatttcatggctcagaataagtagggtcagcaaacatgttaacatttttcttgtcacgaattaacttttcaaataacagcaaaactcagcttcatttttttccccagttttagtctcattgattcagtaaaagaatgcttttgtagtctattcttgactgtcatcttttggaaaagatttttttttgtgaaaggacaggaagaagaaaagaggagagaaaagcagttgtttgaattaaagtgaccatgttaacacctatgactggtctgatgaattgagtactttttaattacttaaatatgtttagtatgttacatgttttaaaatagttcttaaaatgtagtagcgttttttcgtagacacttaagcttcagcatacctgaagaaatgatacagttgtaaaaatgcaatacaatgaccatcgagggtgagtaagtgtgggaagcttcctgaaaatgcagatgcagaatggattatactgcatacatatctacattagggttgatctgggaaattataaaaagtttatttctgagctcattaaacatttcctgcaaatttaaaattgagttggttgtataggaaaacaaaacttataatgaatacatggactcttttcctgatcctccttttaatgaggtaattaaatgaagaacagacaatgtgtacatggccatgtgcctttcatatagtgtaatttaatacagatacatggccacatatgaaaagaataaaattagattttattgattttatattttccttaattttatatgactaagagagttatatgacaagtattgtttaatttctgaaaccatgttactatcactttagttatcatgattcaggccggagcatatgcatcatttccaggtgaagtttgttccagctcatggatcaagccattatctgctctgtgtgcaggactcttaccaggataagaagaaacaggagaatgcattgagctttactctaaactgtgaaaataaacataaactgcctttggaacaatttatgcagtttttttccatcatgaagccaatttgttatctatttctgcatatcagtaaaaacatgttccttattcaaaataaaatatttctctttatatgttactttatttaatacctgaaggtgcactcctcaacttatggcactaatattcgttgctgtggaaatattttcagaactcaagtttatgatttgtggaaagtgtactagagaatcacatgaattattaattaattattttttaaagtatgcttttttctcctattcatggtaaaaataaagaaatgtaaattatgagaaaaagattattttaatatatggtagagtttttttctttctcattagagatcagtggctttatagcttagagtagtttttcttattttttttttgtgtgtgagtaaacttatcctacttttaaaacactctatttgttggtacaagctgaaaaagtatttattgcattttcttcatagttgaaatttacttttaagaattccctttagatttcaaagaattaaatgacatttaaatttatttattgcaaaacttcagtaccattatgccaacttatgtatgatgcttttcttcttgaaccatatgcctttactgcctactgccagaaatcctatggaggttttgctctgagcactccagtaagcaattttggaatgtaattatccagcatattcaacaagaaaggtgaggtggaacccttatttcaaagaaaattatctgcttttgtttatgttagaaatcgcgtattctattggctcctagagagtaggcatctggcttgtggatgcccagtatctattctccattctgataacagcatccagattttgctttgggaattgtgatggttaatatctagtggcaacttgatcggattgaaggatacgaagtattgttcctaggtgtgtctttgagggtgttgccaaagcatatgaacgtttgagtcagtggtttgggagaggcagaccctatgtctgggtggacaccacctaatcagctgccagcgcagctagaataaagcaggcagaagaaagtggaattaacagagttgctgaattttctggccttcatctttctcctgtgctggatgcttcctgcccttgaacatcagactccaagttcttcagcttttggactcttggacctgcaccagtgatttgccaggggctctcagatctgtggccacagactgaaggctgcactgtcagcttccctactcttgaggttttgggacttggactggcttccttgcttctcagcttgtagacggcctattgtggaacttcaccttgtgactgtgtgagtcagtactccttagtaaattccccttcacatatacaactatcctattagttctgtccctctagagaaccctgactaatacaggaatctacacctcattgaatgcggttttgggggcagaaaagtttgataccttttcttactggtgataaggctctcatctgaccgctcctattacaaaagacaggttaacaagagaaaagcatagcaaatgtatttaatcaagttttatgtgacctgggagtcttctgaaatgaaggcccaaagacgcagggaaaactctatttttattcttaggattgatgaagaatggacactcccccatcactctgttactattagatcattcccttttgtgaacacctgtctgttcattcttcttggcctttctgtagtattgcttcctcttgggtatgctgctggacccgccctggaatgaggctctttagggaaggatggagaagggagagggtgacctttctgggttttatggcctgttttggaggagaggagttgccttggggaaaacaaattttgttttctatgacttgcttcaggggagatagagggataggagacagaagggcaggagaaagtcagaataaggctttgcttctgaggctgtttttgaggccttcccagtttcccagtgtgccacagtgccatacttctgtgtcattttctgaagcccaacacagtcctggagggactttcggtcaaggtgtcctgccttcttttatccaggaggtgggttcctgagctacaccaggaaaatatgagtcctacttcagaaagccatcctctcacaggtagtgaacattgtaaaatttaaaatgtcagcgctcacaacatgcagctttcctgccatgtgaaacaaacagtagaagagaattagggagaggaactggaggtactctgccatgttaacattccctggttcagttgttgttgagagctagcttctttcttgtgtatcctgtggtttaactattcaacatttcctttgattccacaagtcaatacattttttctttttttctgagctagtttcagttgaatttctgtcacaaccaaagtgatatctatgtcaattaaatattttttctgtgttcatattcataaatcctccctccctccctttttatttttttcctttcttccttccttccttccttctttccttccttccttcctttctgtctttctgtctttctttctttctacaggatctgcctctatcacccaggctggagtgcagtggcacgatctcagctcactgccacctccacctcagcctccccagtaggtggatgctgcaggcacatgcctccatgcctggctaatttttgtatttttttgtagacagggtttcaccatgttgcccaggctggtcttgaactcctgagttcaagcaatccttcagtcttggcctcccaaagtcctgggattacaggcatgaaccaccttgcctggccatattcataaattatttcaataattataatcagagtatagatataattgtgttttctgcctttttgaagtaacatgattttttcccctaaactttttctttatgtttgtcataaaaaccatataatatattaattggtgtcatagttagtttaccactttatccatgttactaataaatacttgggatttcaaagcagaagagggatgttgacaaggtccaagaataaacagaatggtgcttctgctggaactatgttattaagtaatacattaataataatcagacaagcacaccctttttattagttttttaaactaaactaactaaaaaactgtcaccccctttttattagttttttttaaaaaaacaaagataacagaattttgtgcatttttggtagtattctgtgggttaatttttaacagctggattattgagaaaatatgaaactatttaatgaacatacattttagaattcaactaaaattgaacacaaatgtaaactctgccagtcactacttaagtggcattaattaaacaattgcttcttgatcaaaatgaggatagcttgtcttctgactttgttataaaaatgaaaagatggtatgtagattttaaaaagtgtgtttatcactcaagaaagacgctgatttttctttgttttacaattatttttcgtagaatcagacattgcttatctggtcattattaatttattacttaataacatatttccagcagaagctccattctgtttattcttggaacttgtcaacatccctcttctccttcgaaatcctttctttggtggtgattactttcagtcttggtccccttagaagagctactccatcgctcttccatgggctcttccttcattcgctagcattcctcatggggacagcaactgtgcaaaatagtcttcttttatttgcttcattttatttatcatagcaacacacatgagacacattatctctgtgtctcttcatgactgggaacttgcctttgtaataacagtgattgttatatattaggcattatctgtgtgtgtgtgtgtgcatgcattttcaatgaatgactttctaggtaaaacattttaatgatatagatctatgtaaggctacattggcatgagatgccaggagatttttccattcactctgttttcttcccagtgaaagaaatggttgaaaatctgatggcagcagaactacatgaagactaaatagcacaatagctggttacttacttagaacctgatgataaatttgtgatgtgtactaatataaccaactgttctaaatttttaaaactgattatgggttgattgccacagagtcataggttaacatttttgtagacaactaggtatttctgataattttcctaatcatacagttgaattgtaattatatagcttgtatttatttgtgggtagcattaaaactgcgtataatttacatttggtatatggacctcattcttccttttcattgtgggttcagagacctcagtctaatgcatttgatcccatgtgcctcctgttgagactgtctgcttcttaaaatggaaatttaatttttatgatatttgtatgtgttttgaagcaaattaaaattatagtagttagagttgtggatttgatttgcattttctgaaaggaaaggaaactattgagtttaaaaatgtgattcgatttgaacaaactatgctaattaaatttattttcaaggacactattagcagaaaaaatataaattggtgcaattttccattgcctcattttgtatttcagaagtataattcaacattttctcaacactttgtttttaaaataaagcattaacaaaatttacaagtgacttatttgtgttttaaaagtttactttataaaatattagtcaggaaatagtttcttccctagtttacttgtaaccatggggacaaatatatgtaagtattatcacttgataactggctcaacaacaatgaaattagcatcacaaactcagacttattcaaatttgttgaagctagtttaaagcctctaggtagaaatttattgaaggttaataatttactttaaaatttaagattacaaacaggattgaaattaacctgtagcaagcattatgttttcaaaatagttataattttactgttggggtttaaaatcttgctaagcatttatcattaaggcttctagagaaggaagtaaaaagaagggttggtggtactgaaacctatatttttgagaaaacataggtttgctaaaagatcactgtactttagtctgtcttcagcataatttaggaccaagggtgatgaataagtccattaataccaaatgagaaaaaaatgggggatttttgtttgttttatttgatacacgtggtaaccataaggtgtctatctaggatttaccagttaattatatttgaagggcactttggtcagtagctaggatatgtttctgaggaattaagggaaaccagggatgcataacagaaccacgaagaggggaaaatacatgggaaaggaaatgactgaccctggaaattattaggacatcctgcccaggatgtcattactaaatctgtgttccattattttcataaaaagatatcatctatacacaccagaggacaatggcaagcagacataattgggctgtgaacatttcatatcacgttagcctagtacttttaattagagtttcagtttaattatagtataattctaaactagttgcaggcactgactatctgatgagggagtgcagagattttatttgggacaggttggttcgtcatatcaagggatagctgtgattgggtgcaaaatgacattgaatgcattgtgcaatgtctgagacctgagattaggggaacgtgtcagttcctttagtcacattagagttccattactatgttttggaccttcccttgttcaccttaattaatacatagttacccagaaagagagtcaggttcaatattactacactttacctatgcaaatttataatatcagagggagaagaagatgaaaaggaaatgaaaaatcaaaattaatattatttttgaattaaattatttttataagaaacatgctgctttttgcttttaaacacacaaagtagcagatgtaaatgaattaataggataaagcaagttgctagaaaaaaatacctctcataggaagtaaaatcagaattgtattattgaattaaattattttaatgaaagacatgctgcttttttgcttttaaacatttcgagtggtagaaacaagatgtaaatgaatttgttggataaaaaaagttgtagaaaaaacacgacttttgtaggccttgataatgtaataaggtactactttgctcaaacttttgaaaataaatagataaattgctgggcctagtgttgttggcattactacactgttgagggcttctgtctaaatatttaagagacattcagattagtataattttattttattaagaatcatgcagctaaggaagttagccttagttggcccagctaagaaaaaaggacaatgttggtgcatcaagtggttttatgagcaggataccacctggttccgtgctctgacttcatttgttgttgtctggaataataactcttcattggcttaatgcctttgcttgtaagagacagatgctatctgatccctcctgtcagaagaattcccagaataagccattcaaccaagaacaattgctgtcttgttgattgcaaacagtagaagagggaattctctgtatttcctagcaccttgctgtttggttggtgtgtgttcatcagtagcagaaactgttcactgaccgacgaactgaagtggtacatgggtggcttttgaggcgcttttctgtgatttggctgttactactttgagttaacttctcactatctaagatgtccacattgctagtttacttttagcctttccattgagtctgtttcctaaagtatgtttctatccacctcttctggtgtataaattttattttaaacaggtctctgtttctagtccttcttttctttctccaccccttttcctcccatgtctcatgaccacatctcattcataggcaggattttctttaaggccgctcccatttcagagtagcgtaagcaatacattgtggctaagaacaaatatattacagtgcaatatgaactatgagaaaatgtaaacagagatgcaactccgaaatgtatttccaaattcactgtaggcttgggtggatattatagccctgcctgtttcacttatacttcacgtcttaaaagatctggggaatgttttccaacatcattcagcacagttctaggtctcattagggccggcagagtcaattttcttgtttgaactgctaggggcaagtcctaaaaacaaacaaccaaaaagaaacagtgtaaattgctaattcgtgtcattgcctgaaatccatgcaagcaggattcgttcattagttcttatttatttatttttgggatagcatatttgattagaacaaaattcagttctgagaagaaaatgtacggtagccaaacagttcattttagaaccccccttcatttagttagccagcctttgtagtgtgcttgttttctgcaaaatgttgtctatgtagtcctggaaaagataaaagacctataagacccaattctttgaagtatgtatgtcttgctggatactcttaaaatgtatattcatgaaagttcttggtagaggatgaagactacctatcaacaagtcaacagtattataattataattataatattttcaatcagaatatctccaaggcaactgaggaatgatactgaatcaggtcaagaaagagggaggtagatttacaactagaggagaaaaagatgtggaagggattcttaataaaggaggtcttgataccacaatccctgcaatacaatgttacagtatcacatggggaaacagacatcattatggtaggaaaataatgaattagttggtcacttaaagagtgagtttccattcatttatctaatctttgttcatcatcttgaaatctgcattggttagtctattggggagttttgcaagttgtaaacatccatcaatgtaaagcaactaaaatgcagagcatttggtatgcaaaattgcaaatatgaaaaaagatatagaatttcatattctaaatcttggcaatgaggtaagggaagtggccagttaacagttgaacctaaataattggccacatatttcatgttaacagctgaatgaaattaaagactatgtatgaatgaagaaaatacattttcaaaattacttcaaaagataaggtgtaatttgagcttttagttttttttttttcctctctctctctgaatttagaattgaaaatgcaaacctatttgactctttatgggtcttgcagtttgttctcagggctgtaatgtgtataaaagtaaatgactgtccagggtatggtatgtgtaccaatctagtagcggagatatgttggtaagaatgtgacaaagagaatgacttaaggaagagggattatagcactgggtaaagagaagtgaatttggagaagcagtgaaagtatttttaatggcttgaatagtacagtgtaagattttaggttttgttccctgtgatgtatgaagagtgggccttggccatgggtggctgatgtggtattggaagcattctgataaagtgggcagaacactggactggaagtcatgaaccctgggctttgtagccttggcttcacgtccaattatgtgaacttgtggaagttaattcacctttttgagccttagcttttcatcaggaaaatgagggtgttaaactgctctgtaagatgccttacctgttgtgtgaggttattctgtcaattcagaactgagaagaaactgaaggtgtgtggatgagctagggactaactaattcatatgtgaggaataaggacatgagctggaaccacatttaaaattgaagaggaatggatagagcacggagatatggtggaggtggaaatggtagttttttagacaggacgaatgttgataaagaagagaaagagtcacaaataactttatgagcctaggggtttgggaggacaaaagtaatactgaagattacagggaatttaggaacacttgcttattgttgggggaagaagagctcaggttttcacctatccaattttagttgacatgtgagtgagatgtcctgcaggcatctggaagaacaagcgcgaaaggggaatgagagaggtcaagcctggtgatggctcctgggtttcagccacagtcaggctgtcattagaacagaaagtggatgagaacaatgagctcactgaggaaggaatcagaaaaaagaacattggcctaaggtgtggtattggagtgggagtcggggcagcactttcgtgtaattcagagccaacatgtctggaagttggaagtcaagggcaaacatttagagaaatgggaaaggcaaagggaatctgagaggttcagaaagccaccactgagtttggttatgagatatagtaagtggattctgggcaactgccttgagccttgagctatttcttgaatattgaagtgaaagaaataattttgtggaggaaatgaagattataagaatagagtgcttattttaaccaaaaaccagaagttagacattctagcaagtaggaaaatagtgttaagtaaaattcaagacacttaatttgtttgctgtgagaaaagaaaagcttttttctccttttaattctgctttcaacgagcaattaactatcccctctaatcatttctctttcaaattctacctatactggtttaccatctatccaagtgaagcatctctctcttaggaaggcagagagtgaaaacctatgtgtgaaacctctttcttaatactcctattgcaattaaaaatgtaccccctcccaatctgtttactacaaagaggccctatgccagcttggtgtcatgaccaccatctgtaaacactatgtgtgaattaagatggattttgttacagtgaaatttggacattgactgggattgagtcaacatggaattttataactccatttagttcatacggcttaaagcaagctcgcagtgatctacatgaggatggccaaaattactgggttcccctccccctaatttttagtgtcataatcatttcagaaataaaatgcagaattttttttttccatctgagacattgaattagttgcaataactttgcaccagaatcatacagttttattgatgctggggaagtaaagccctagtgaactgggccattgaacacaccataaactttgtggcaggacaagttttctgggctagtcattaagcacccttttttcaactggaacaataccagctacactctagtagagtcagtgtttgctgaggctttattccagcttcaaatctatccccctgcccactgagaacatttggcttgctttatagctctctagggaggagtgggagcccaggagcactggctgaggaagagtcagccagctggatggctaaggtgaagttggtatggagctggttgctcaactcacctgtgagtccaggaagaggaagtactataaggaattttgtatcttaggaattttatttcctagcaatatatcttaacctaaaactggagatgcttctttatttgcctgtaaattagcaaaactttaatattgtcttaccaattttatttttgtatccataatactgcttttctctgatatgggcaagtgaaaatgaaagtaactgaaaatgttctgctgaatagcaaacacccaaggcatcgtcatctttacttttgctaaaaaacaaacagaaaacccccaaaactcacatgtatttgaaatcatctctttccgagagtggcagagtatcataaaaatccaaaatggcctgtgcctatggtcttgttttgtaacattattttgtttgcatttgtcagcatgaaggtcactttagggctacctgaatatctgtattgcactctccagtgtggagagaagaccaaagaaggttagagcagttccggaactagcacatcaaataaaagtaccaagcagtacttgaggtgtggtcagctgcaactctttgcagccaccaatacttaggcacagtgatgggtccagaatggatccagtgagaaggcaaaaaaggaaggtctcatgtatttgctggtattctatcagaaaacaagagttaggaaggagagtgtaagtaaggcatgaaggagtccatgagccataagcaaaatcacatcaatttttaaactctttgatctttgttctgctttttttccccactgaatggtagatatcagaacactatctccaaagattgtctgaattaattaattcccaagtaggcaggaataccaaaccctctctttcaatgagtttaaatgacgttccacacatttgccctaagtaaggtgatacttaaattgtatctttacacgtattgtgcagttcctatcctaggcctcttcattttggtggcagtggcaatggcatatggagagtgatggctggagaaggagttgttaaattatcctcaaaggcctcagaattgaacattgtttcttatttctgtcctatgaaaaaagacggattttaattatgatctttttaaaatcaggttgggtttttactaataaaaaaagtcagtgtttaaattgtatatttgaatgttttctctctacatttttttaatcacaaatatcagctacatgttacacagtttttcatttcttagtctttttgaatgaaataagtagtcttttctttggtgcttttaaatactattagttgaaacttggtggttattcttgaaatttagcttttagaatttaatttattctaaagtgtacagaaaagagattgcaactttgtggtgaatgttgaatgcagctatgaaaacaatgttaccttttttcaagatctcttgcctagctataatacatctgctagttactaagtgtaactgtgtatagggtacagaaaagagattgcaactttgtggtaaatgttgaatgcaaccatgaaaataatgttaccttttttcaagatctcttgcctagctataatacatctgctagttactaagtgtaactgtgtatagggtacagaaaagagattgcaactttgtggtaaatggtgaatgcaaccatgaaaataatgttaccttttttcaagatctcttgcctagctataatacatctgctagttactaagtgtaactgtgtatattttctttaatagaatttgttagcttcctgaaataaaattagcttgctttatttgccacaaatttgttactttttctaaaatttagttcagggtaatttcacaccaaaatgggtaaacatttttatccttcttggctttcatgattgctctgacttcttcataaaatttggaaatcacgttttaactttttattgcctctttattaagtgcttggaaaacacatggaagcctttttattttacatactgtggtaacatcctagtaagattttattcgttttcactctcaagattgattttttttttttagaaaagcagtttagaaagtacccatactcgttgaaatttgtcatcatctagaccttaatatcacatatcctaagttccccactaattatttgcagatttccaggacttaaatatgtgctaaacctgaaaactatgaatgcatttgctgaatcaaaccaaaatgaaattgttttcttaactatgaacgagactaaataattttaaaacactactcagccacagtaaaaagagtgttgaaataaaactaaatatatatatggtatacacttgttgaactaagcctgctttattaaaatgactttatgattctccagtgtattgtttatacatattatttctaaagattcatgtttagctgataattcatactgcttacatatttttggattggttgacctcagacaacaaggatggtttctagcacacaacacattctgaacatatcatgagcaagatgctacccaagttgttttgtttgttttcttaaatatttaaccaacaacaaataaaagtatatattcaaggtactaatatgatgatttgatatacatatacatgtctaatgatctccacaatcaaatcaattaacatatctgtcttcatccagagttatcatttgtgtgtgtgtgtatgtgtgtcccaagatattgttgagggtctgattttatgaccccagtaaaaatgatggacataggctcttgatatgaggggaaaagtgctgtaaacacaaagactgccttatggggtgagagtgtagttcttgggtgacagaagtaaatctgtactgtgaatgtcctctttggagaattacaaaatgacatgatgactgaactgtaatggaaaacttgttttggtaagatatcctttctaaattttttttaagaaaaagaattctaagtgctgagttcaaagacttagtagaatgctactgataggaggattttagtgtcagtattaaatactgcacaaatacttgacactgaacatcgtgtataatggatatggccatatactgtctttttaaaggaagtgcttcctgctttttctccaaaatagcaacatatttttctcattagtgaaatgatggctctcaaataaatatcccagcccagtcctctgtttttcagcccagcctgtgcttcagatttacctaagaccataacccacagtgatgcccaggagtacctcaatctcagcatacttaaaagcaattgtattatttgtgcccaaccttgtttcttatgaattttgcagagttttagttacctaaacttgaaacttgccagttggccttggttcttcctaccttccttacatcaaatcttgcactgtctccttaaaatctctcatacctatgtcttctgcatattccagtactgatgtagttaagaccttcagagtatcattcctagaccgtggcagtagtctcctgtcttccactttagttgcacagataacatcccctaaccaatctatctttcgctgttctcgcgaagtgatctatctgaaataaaaatctaatcatgggagtctgtcttaaatgttcactgcctccctattgccaacagaaagtagctttacctctcaaatgttttctatgcacaagtcactctttaaaaatattatattgtataatccaaacagcaactaaatgaggtacttacctttattatcaccattttataaatgaggaaacaaatacagagaaaataaatacctggcccaaggtcacatagctgataataacagggccaggattcggcccaagcagtctgatgatagatgccctgtgtgtaaacactatgcaatgatacttctaatttcttagcttcccacaaaggcagggtttgaatttcaaagtgaaccaagagaggatgggcccattttatatcatcctataccaatgaatgtggcctgccttgccacactgtgtaaaggagattgtttcacattttatggtataaacttaatgctgaaaggcagtagttcttatcgcctgagttggtacaagtactaatggttcttaagctatttattacattgtatggcatcagttttagttgagacattgggtgtttgtaaatgcattcgcaacacccatacatgatcttttccttttagcagcatcttttcctgcccttgtgctgttgacagtttggggcatacattttgctgcaaagaaaaagataatgacagtgagcattggtatgaaggtatttcccttcttgcttctgcctgaggcacttgtgagttttcagttgttgcagaagttctgaaaacttttatattttgatggacagagccattgaaaaccttgtttcttgaagttaagtttgatttgagaaaaggagtatacagatacttatatagccatatgttgccaactccttgccatttattcagtccacagcttgttcttgttctaagcatttattttattttctgaggtcattggtttttctcctaggatcaggtgagttaggaagatcattttttttttccattgaagaatgtagtgttttctaggacacagttcaaacttttgtgaatgtcttaagtcagtttctgatgtttctttcatatgagaacccttcatctatttgatgacagctctcatgtcccgtgatgtcacctctgctttaaataaacattcatgtttctcttacaacatgactttcagggtttgtttgtttgtttgtttgtttgttttcccctaccatcctgctctccctttgaattaggagactcaagggtataattgaatatggtttagtgttacctagcaaaacactggcagtgatcttacaaataatttagttatcagtccctacaccttgttttattatttctcgagcctaagacagtggttattgcatgaagatctgtggcccgttaggttacatggaaaggagtgattcatgaacagactaaaaattcagattatacaaaatatgtcaggttttgtttttgttttactttgtctttaatgtttgttttctactttgtttattatagaaatggatgctcattctagaatgaaaataatggagtttcaaaaatgtagctttttaacccagtagtagctttacaagataggttttgtatgctgatcagcaggagattctggttatctgagtcttcagaacattcgttcaggcattctgtactctgagagactttaagatcatggaaattaagagttttgaaagttctcaagttctcaaaagcatccttgaaaaataactaggaggtgagtcatttaatatttctgaacatctgatttctgatcgtaaaaatcaattaggaaaattaccactttgcatccataatagtaaatattgatttgggaaagaataatcattggatactaaattggaattaatagaaatttgacagagagcaggatatttgcatggtcttaaagcacttccctacagacattttgttaattgcaaggcaaaaaaaaaaaaaaaaaaaaaaaatagtaaccatatagtggaaaaactgaatgtcaaaattaatatcactgaggggaggcagacagatatcatgtgctttcaggtatgatactataagaacacaaaaccacttttgtagcattctggtgaagaatgcattacctgaatctcatcatgaggaaatatcagacaaatccaaatagagaaattgtctaaaaaaatacctggcctatattctttcatggcagtgtcatgaaagagaaaaaaggctgaagaactgttttgcattaaaggagatttagagatgtgagttgaaactaaatgccatgcaggatcctgggttgaatcctagactggaaattatacttaaaaaggacattatggagaaacttggcaattgaatatggactgtgaattatatcaggtgtttgaaaaattttaaaataaaagaagaaatacatattttagaatttgcaggcaatactgttgtctcatgcaacaactatccaattctgctgttgttcacactgctgccacaaataatgcagaaaagaaggggcatgattttgtcccagtaaaactgaatagatgaaatcaggtggcagactagatttggttcacaggtttgtcaaactctggattatataactgtggtgtatcaatgttaagttttcttaatttggcatcaatattgtgattatataagagaatattgttacagttggaaatatatattattgaaatattggggttaaagagcaagttgtatgcaaccactctcaagttgttttaaaaatattaatatgtagaattatatataataaatggtaaatagatgtaaagatgggaaatacatagtagaagatgttgaaaattggtgaacttgggtaagggatattcaggagttctttgtgttagtctcgcaacttttctgtaagtttgaaattatttcaaaataaaaagataaaaacaaattcagggagttccctaagctaaagggggggggggtgtcaaaaattcagggagttccctaaactaaattggggagggtgtcaaaaaacaaaacaaacaagcaacacacatgtgcacacacccacttgccgcatgtagctcgggtgcaccacctgtgacataacgaaccatgtgaataaacagaagcaacacaaccgggcttctgaggcactattcaaataaaacacagaattaatgaggagaaaatttcagagaaacaaagaacagaattagaagcaaaagctcagcagaatcacctgatttcacttggctttatcctctctggagggaagaagcagccttggagagatggcaaggtgtggctgtgttgctgtcaacttctactttgccctcttgaactgtctccttcatctttccattctccaccctcttctttcccccctctcttttcctctctctctctcttttgtttctgcaaccgccttttttcagtcttcttattttctttggctatgttttattgcccgctcataagctggcacacagacttatttgcttctgctatgttcttattatacattagctcaattaaagtaattgaagagaaaccataatcagcatgacgatattcaactcatttgaaacccagccccaaatacagtgtgaaaatacccattgttaacttcatgcacactccacatacacctgttgggccactagcttataggtaaaaataaaaaagaatgtattttatcagtgagtccatttgcctggtccatttcacagccaggccacattctccttattaattgacctgcttttgttgtgagttttttttttttttttttttttaggttgttttgtatctagtgaatgcctttctgatttaaatttttcagtaatttataattgctttcctttaaggcttctcttttctcctctgtaatattatccctgtccatctctattgccccaaactgttcttggtaagtttctatcattattatttttttctggaacaggattgtctgagccttttcttctcatcttccctaatagctagaatcttctgcccattcacttttcccccccattcatttcctgcctcagtttctacttccaaatgtcttgaaaagtaaaattttattttgttgagtaaaatgtaaaaagaatctcacagtacttatatcagaaaactggatgccctgtaaaataccttgatgtgtggcatatttcttacagtggctgggaaaatgttgaatatatgtattctctgaccgttttcaactattggccatgactatcattttctcccaggaatattaaattcatttaaagcccagagaacagtgttgcataaaatttgcttttaaatgatgtccttcagtgatatttattgaaggcattatcatatattctaagaatattttgattctctaacttatagaaggcaacctagctcttaatgtaatgtgattttaactttccttgtcttgtttattttcagtttggtgacttactctctcctttaaaaaaaaaaaaaaaggaagaaagaaattcactacatggttaaatgcagtgaaaatgtgtactatagtttcttttttttcctttctttttaactgtggatgttaagctgtatagcccagacttgtaatagtttgcaggaaaggcttcttagccattaaaaaaaaaaaaaaaaaaaaagagagagatattgtttcttcttctagataatgcctcattgaacctgtaaaatctgtatgttaagaattatttaaaagaaaaattctgcacaatattgatttctttttttgtcttgcctcttctgacatagaaaaaagctgcaggcaagtattaactgaaacactttctaagtttcaacaccaagttctcttacttgaacttagtgtttttgaaagatgatggtagtgctatagtaaagcagagactttgttagaggcccaaagtgaaaagcactaggctattatgaataattttgtgaacttacgttggattgattttaacatgactacttttgtttaaaaaaaaacgcattagaggttaagaaaacgatttcatagaaaaagtcaaagctcaaacaacacttcataattagcattcaggacacaaaaacacttgagaactctagaaaaccttagaacattccaataaactcatatatatatatatatatgaaaactgagacccaaggatgaataactaattgttttaatggggtctgaaatagaccatgagttccccaaactacaagttatataagatggttagtttattattctgcttaggaataacaggatgtataatgttttcattgttgttagtttgttgttctgttagttgttgaagtatgtattatactagttttctatggctgctgcaacaaattgcaacaaagttagcggcgtaaaacaacacaaatttattctcttacatttctggaggtcagaagtcaggagtctcactgggcccataaaatggtctgcagggctaggttccttctggagtctgtaggggaagatccatttccttgcctattctagtttctagaagtcacctatctttcttggctcatggccctttttctctctctttaaagcccacactgtcatctcttttctttgctgcctccctcttccacatttaaagacacttgtgattgtattgggtacaccttggtaatccaggacactctccccatctcaacgtcagctgattatcaaccttaattcctctttgccggataacctaacatattcacagtcccagcgattaggatatagacacttgtgtttgttgggggcgcattattcagcctaccacaagtctaatctaaatattcacattaaaataaaaatatgacttgaagcagccaaagtcttatttgtttggaggcatagatatcaagttaacttgattgttttactcttctgtttcttctcctatcctcaacacttgtgctagaatatctctttaaagctactccagggtgttagtaaataacaataatataaaaaatggccagcattttgtttcattggatttgaaatggatttctatgttggaatatacattattttggaggtatttttaggttattggaagccgagtgcatcaagcatgctctctttgtgtgcattctttattaatttgtaacagcagcttcccttggcatacatctacagctaagtacacaagctaaccttttgtttcttgatagatggcttaatatatgctttctagctagataaaataaatggaggaaagcacttccttatagtagtcatttctgtttcttcaatgttagatactggtttgtttttgctcatcttgccatggatatagtgatctttttttcctacaaatgtgaaaagtacatttatcgttgctatcacctaaatacttcgtttcaaaaaattgtgagatttctttatcaatgggaacttctgtggaaaagaaacttaccctatgttggtgaaattgaatacattaaggtttttttttttttttttttgaaaaggtgtttaatgtgtatattgaatttccctggcttgaggcagtgttttcatttcgtacagagattttaggaaattatttctgattgaaacagaaacattggaatttgtcaaagggttagagaaatctctgactaaagcaaagtgccaaatactagttaggttagagaaaatttaggagaaaataaaacagaaccaatggaaatttgcttcttgggtgggtggacatgtctaaatatgaattaccaacatggaggttttggtgttgtccaccgaagtcatggaattgctggaggttttggtgggaaattcttttctgcaaatctattttagaaaaagttttctactcatgacaatttatatcaaagataatatttaacagtaatacaaacttgagaacagaaaaagtccaagtagaggcaaattccttgaaaataaacattactgataagcaatgttattgtattgtattgtattgtattgtattgtcaggctcttaaatgaaggccctaataaacttccattgaagagtttatttaactaaaaacttgaaattcaggatttgtgtgatgctgccagactgaaatttggtctaagattgtgtgtgtgtatatgcatacatgtttagtaacatatgcatgtcagcctgttaatattcctacaaattgtgagccccaaattcgtttgtactggtggctcaatcagcagttaaagtgttgccctctccatcatcaactaagatttctctaatcagaatagtctttatttatttatttgataataatttgtgtgtccactaattgccacgcgttgtgcgagatgttagacgcaggatactgaatataagcaaatgtggtccttgacctcatggagtttatagtgacactcaagtcaagaaatcaattaggtagttggatatataggtgtagagggcaaaggattatatctagattatggaattttaagaattttaatgggacagttacatttgcttctaattgaagctattgatactaaggaaaaattccaacatttaatggccaatgagaggattaatgggacagttacatttgcttctaattgaagctattgatactaaggaaaaattccaacatttaatggccaatgagaggattaatgggacagttacatttgcttctaattgaagctattgatactaaggaaaaattccaacatttaatggccaatgagaggactatgaatttgcaaaggaaacctacgagtggccagaaaggttggaagaaactagtaggtttacataatggaagccaagaacatgaagagaagtaagtgatcaccggtattgaattttgctgaaatatgaagaagagtgagggctgcaaacatgcttcgcgttggtgatatgaaagtcatcagtgaccttagacaaagtggtttcaatgacacagatctgtaagttttcttacggttaggatgtagttcttctgggagtggatatctaaactcactggaagtgaacatttgctattttgtagaattctcatctatgtgcagggtttactttcttctttttgtatgtgatatttatcttaccctctcaacatcaaactgagtaacattagcaagataggatttgccattgttaacactgcactaggccagtccaatggctcctgcttataattttagcactttgggaggctgaggcaagaagtttgagaccagcctgggcaacgtggcaaaaccccgtctatacaaaaaatacaaaaaaattagccgggcgcggtggtgctcacctgtagtcacagctacttgggagactgaggtgggcggatcaccctgggatgtcaatgctctgcagtgagctgtgactgtgccactgcagagcctggaagacagagtgagaccctgcctcaaacaaaccaacaaaatgcagttcactgtctgccttgatataagcataattttctttaatcctcgtgtccaaaatataatagtaaaagcttcttttgttatttttagtatcattcagttttagttgattctcaacttcagtctctctgatattttttaagggtttattcatttgtatattatttttctcttacatttcatttaaaatttatgtatattaaatgccttagctgaaaaatattgtgtgcatttctttgaagcatactctgccttttctgttgattcattttccttgtatattcaattaaaatgagccatattgtatattgtgtgcaacattgtatattgtaaaatgagtactcataaaatccgtttttctcatcccaaattaaaataatttatttttaaatgtctaaatatctggccatgcctactatcccccttgctagttattaggaacctaattgtcttgtgtttctagactctgacatttcaaagacctgaaatgcatctacttacagttgttaccctgtacctgtaggaggctcttgtacattatgcatagaaagtgcctcaaatataattgctttattttctagattaagaaaatctgtgttagaatattcgtctttgacaattcttgcctatgctattgtcttctttaagcttcagaactaatttgctttgcacttagtatggattgtctgacacatgaattaacaggtaaaatattgtatatccagtgtgttttttcttctattagatttctttatctgtaattgtggcattgacaaagacttggcagtagatactatgaagacagattcagccaagtaaactgacagtagttgctacaagaaaacattcaggaaaaaaacatttagtaatttttttcccttagtctgagtaacaactgagtaacaagtcatagtaacaagtatgacttgcttcctaggcaggcaaccagtgcagtgacacaggatcccaaattcagaagagggtccacacttggggtttaatatcctgttattactgtcttgaaatttttattaattttatctttgattttggttttataaatgaagccccatgagacaatgggccgagagcttgaggcttggaccctctgctcacatatggtctgcctcccatgcctcttgccttcctggggtgggttagtgggagcttgggcacaggtgtgggtatggttgagtttggtaagtatttactgagttatgatacagggccccaggtacctgtgagggtctctaatcacctcatggatagtcccatgcccaagagagcttgtcattcaatagcaaataaaaaataagtgacaagttgagagagacacctgggaagaaagataaaggaattcattttcctggtgtttgaataaaaggcctgcattttcattttgttctggacaagtgataaagtcagccctgacaattgttaatagtgaactagtgcttggaaacaagcttcacctttggaacttattgattcgtttccataatttttacattttttttaaacatggtatatgaatagatttggttgtacttagaaccctaaggaattcccaaatattttataataagaattgtctttccacagattaaattgtttgaaattgagctatttatagccttatagtagtaacaaaaggaatttgaatttaaaatatggatttgcaaaattaatatcaaagttttacaattatttttaccctgaaattgttgaaaaaaaagcaacttgtttaattaaaactcttcatgatcttttaaaattttcattttatttcatgatttagtgtgtgaagactttttttacgtaaagcttttctatatcttcactacctttccctgggtcccacgttcatttcagccttgtctttactctcaattggtttaacataccaaactgctcttgttggaaattataaattttatttgactgctttattgtaggacatatttgctttgcatgaggacttttaatacatcagaatagtgtagggttgtccttggcaaaatcccaaaccttttttcagagcaaaaaacaaacccgggagagagaacaaattgtctttaatctttccatccatagcctttgtgacctctgttattgcaactcctgtagacctgcagtgttttttttgtgttgttattgtctttttttttaaatctcagtgatcttattttattttcttctaaattaaaaaaaaataacattggtgttatggctcgaattttgtcctttgtcacaagttggaagagttggttatgctggtgttacaggtactcacgggggaatgtgctggagctgttgtgtgaccatctgttgtatatatatatatatatatatatatatatatatatatgtgtatatatatatatatgtatatgtatatatatatatttaaactaaaataaaggctttagatggctcctggtgaaatatataataacatgttaaaaattcttaatttattacttttgatgtatggttctatcagcacagcagatttcagagatctgctttgttgattttttccaaattaactttttccttccttttatatctcctaaggcagatcacacaaatggatattttgggttgttaatgcactcttttcttactcaaaagtcctagggaccttaagtaatttactttgccttctgtgccagctttcatctagtttatgtcttcatattttctttccatctagagactagacgcctgtttgacttaatagttgaatttatgactttttacttgacttctgttgaagcaactgtttagctacatgaagagatttttttttgtgtattttttatagtttggctcattgcctaaaatattatgcaatagtgagtaggtgctttgcattccaggcataatttagtttatctaaaagtttgtcatgtaattcatggaggaatcatttatttaaaagtaaagtttggccgggtgtggtggctcatgtctgtaatcctagcattttcggatgctgaggcaggcagatcgcctgaggtcgggagttcgagaccgcctggccaacatggtgaaaccccatctctactaaaaaaaaatacaaaaattacccgggtgtggtggcaggcacctgtaatcccagctactcaggaggctgaggcaggagaattgcctgaaccctggaggcgggcgttgcagagagccaagattgtgccactgcactccagcctgggtgacaagagtgaaactctgtctcaaaaaaaaaaaaaaaaaaaaaaaaaaaccgtgaagattgacttttatagagaaggctgaattattttgcagaaactaaataaaatttgaataaaatacttcaatttctcacttcctaatagctatattagttttatgttgttatctggaaaggtgcatatctttaaagtataaacttgttttatataaaactacttaagataaaatatcaatgttatagagctaaatgctgatgggggccttgaatggttggtaaacgttggatagatgtggcatcaaggtgcatttcacaggtaaattgaagcctttgtggtttgaagaggtgaatgtacatcacaggcattcaacatgtgtaagcagagacccccagttctaaactggttattaaccctgggaatagcacattggaggctgccaggtgatccaaacactagcatcaaacacttaattttaactgttgtaagagagacaatagatagtataaacaagcagagagaatataggacaaacttggaagggcagtgcttgacttttctagttgtgaataaattctgaaccttttcttccacactttatctgcatttgtcatatagggggcatcactttctaatgtacagttttttaaatattttaccttttgtggtgatatgtttattgaggacaggcatttattgttccttttttatagtccccttgataacccaattaattaattttccaagtgtcatgcacagtgtgataggggttctaggtgtagctagatgtgggactaaaaaatatttaacgaagaaattaaaatttacctatttttgactgggcacggtggctcccatgtctgtaatcccagcactttaggaggccaaggcaggtggatcacccaaggtcaggagttcgacaccagcctggccaatatggtgaaaccctgtctctactaaaaatacaaaaaattagctgggtgtggtggcaggtgcctgtaatcccagctacttgggaggctgaggcaggagaatcgcttgaaccctggaggtggaggttgcagtgagccgagatcatgccattgcactccagcctgggcaacaagagcaaaactccatctcaaataaataaataaataaataaataaataaataaataaataaataaaatatacctacttttttcccagatagccttccattttccactctgttttcacttcatgttcctcatcctttctagccattcctgtctttctctgatgtccctccactctctagatctattttgagccattaaaatgtgggtagtctgaattgagatctgtaataaatgctaagttacatcacgggtatgataagaacaaaagagtgttactatctcattagtttttatattatttacatattgaagataatattttggctatattggattacataagtattaaaataaacaacatgtgatttttcctttctaaaatacagtttactagcaaatttaaaattatgtatgtagatttaattatatttttattggagaatgctgctctagagtcttttattgatttttttctactaactctcttaagacacctttttgcctaatctcttctgctcaaaaaatattttcatgggggcctgaaattagaagactgacaaatctagccaagcacagtggcccacacctatagccttggctacttgggaggctgaggcaggagcattgcttgagcgcaggagttggagtatagcctgggcaacatcgcaagaccctgtctcttaaaaaacaaaagaaaaaaataccaacaaatcttctgaaacttgtctttaaaaatgttagatgtaatatgaaaatgttagatgtaatattattcatcaatgatgcactgataaatgcaatcacaaacattatgctaaaataaacaagtcaaaatagaccttgttctatataattccagttatgtatgaaatgtgtagaacaggtaaatctgcagagatgggaagtggttgcctaggaaagcagggaggaggaagtgaggaatgactgctagtaggcactaggtttcttttaggagagagaaaggtaaaatcagagagtggtgattgttgcacaactctgactacgttaaaagcctctgaattgtacgttttaaaagggtgaattttgtggtatgtgaattatatcttaacagcagttaaaacaaatttaccttatcctttattaaaatcaactttgctagaatttaagtgtgtgtttttgttaacgtcaattgtggccaggtgctttcatcttaaaaaatgaaaaaaaaacaggtcaatgtgtgctggaacttttgtaagcagttaattcctttttaaaattggtgtgtgtgcaaaatttattttaatgcagtttttcccccaaggggacttgttaggcaaatgtatttaagtgtccttttaatgcattttatagcttcagtttattcctttataccacagtgatgttccaacatctgatgaattctggcttttcattaggacatctggatttcacacacacacacacacacacacacacggaataacaaaagataaaacatttttcacaaggtggttatacatatctatactacaaatgtataaatatgttttttcctaacaaatcttgacaatacagaggttgatgtgctgaagagaaacacttcgattaaattggtccattataagaaatgaaaaaagatgaatgtaaaggagtattttaaaaaataatttctttccagcttcatttttttcttttactattcttccttaaagatgactgtaaactggaatatcttaggttaatattatttttatatttacacctctaagtgttcattattttatatctgtccttcattttgacatggctaattttaaccttcaaaataaatatataaataaaccaatgtaaaactaatatcaactttgatcagcttgaccttaactaagcaaatagtggagaaatgaaagtttcttacagaagtttaatgtcttaaaatggggagaagcattttgctttcatctgctccatcagctacactgggacagcagttgtgtctccattaaattaggtgtgctttgattctccaaaataaagaattttctagacacttgacttgtgtcagtgacttaatagagaaggaacacccccaaattggcaactctgtttatctttaatgattacttcttttggaaggaaaagggcattctttcttttttttttaaagacaggtctcactttgttgcctaggctggagtacagtggtatgattacagctgctcactgcagcctcaacctcctgggctcaagtgatcctcccacctcagcctcttgaatagctgggacttcaggcatgcatcaccatgccctgctaattttttatttttagtagagacgagatctcactgtgttgctaggctggtctccacttcctgagctcaagcaatcctcccaccttgaccttccaaagtgctgggattacaggtgtgagtccccatgcccagctggaaaagggcattcttgatgattttcaaaccacagctgggacatacaatgaatctataatcaataatgtattattactctccactgttgacatggttttgatcggtgtccccacccaaatctcatgttcaaatgtaatccccagtgctggaggtggggcctggtgggcagtgattggatcatgggggagttttctcatgaatggtttagcaccatccccctagtgctgttctcctggtagagttctcatgagatctgattgttaaaattgtgtggtacctccccacttctttctcttggtcctgctcctgccatgtgagatgctgtgctccccctttgccttctgcatgattgaaaactccctgagccctctccagaagcagatactaccatgctgcctgtacaacttgtgggatcctgagccaattaaacctcttttctttataaattacccagtttcaggtatttctttatagcaatgcaagaacagactaatacaacctctttgaatcttttcccattaattatggacaactgttatctccagtgtaatgttattattctgatagataagtaccatgattgtcttgtttattagaaatggcagcccatgaaggtttcttacttggaggaacttaaagaatgatagcaacagactatgagcattttcttgcagtctatagagtacagggccagacttctggcctgtgctgtttcactggttcaaatgactccatttgtatttgctgtggatgtctgtgttttagtagcagctttgggtataaagctgtcaaagccatcacttcagaattcataggtgatccacagagatccaggtggtgggagaatggctttcaaggtgaaacttggtgaggtggaacaaggtttccaggtggttgtgggtttcttgcctgtcttccttttttcttttgtcccattgtaagtagtgggcataaaagctatgggctataatgaactttgccaagttttgatgccatgccctgaccattatagaagcccggtaaattaatttagtgtgatcgtataactataagaagatgtttttgatttattggatattaaaacttgaaggaacatagggataatgaaatttatcctactcattttccaaatgaggagcctgccaaagattcccaacacatttaccattaatctttttcttcctttgcaatagattcctgatacttttaacctgtactgctcatatttaaacattccaattttcaagccatgaggatggctttttaagtgtatatataattttaatgtcaatgcatgtatttccaaaattctgtgagctttaataatagaaggaatatttgaatgaccatgagaaatgtccgtcgtttgtgtgtgtgccttttcattggtgacagagatgagtgtaaggagaagagcataatggatttctttcacatatgtaagcaaacaaatacactgaaaaatgctctgtgattctctcaaatggtatggtttcttttttattcctctagttttattgaattttaattgaccaatacaaattgcatatagtcaagatgtacaacatcatgacttaattcatatatacattgtgtagtgatttctacaatcaaattaatacaccgttcaccacacagttgccattttgtgtgtgtgtgcaagtgtgtgcgtgtgcacatgcgcacataaaaaggacacttaaaatctgcttcaaatggcatggtttcttattataagcaattaaatgtagacatttatttcaagtcatattatacaaatgtgtagtttatactcttcttagagtatattttaaattttttagtgtagagttatcttccatatattctgtatttatgactgcatactcatatctgtaaggagagtgtcatctttttattaacttattttataataaagtgaataaaacagctggcttaatcttaagaataagcaatccctgtcagatgattgactcttcatctgctctctgtatactggccctgtttcctttttttgcccaaaacatttacatatttcctgatttttagtttggatggaggtggggagatcaattttcttattgctattcatcttgacagtttgtgccactaaagtaagagatggagagaaattttctgaatgttcaagtccctatggagaccatagtgttgacccagtagagacagttgagaatacaaattgggagactgattttcttgccttctctactatttgtatatttgacagtataaggtgtttgagggcagtacatgtggaaatgttaaggagttaacattaatagtactgtggttaaacagatggcgtaattagcccgcaatggggaagaacaatgttttcgtgtttggataaaaagggcacactgtaggtggtagaataagaggttccaaatgacagtaccttatgaagatcaggcaagtgacaattttcatgatttaggcacatatctgtgcatatgtgcacctatatataatctctagacctatttttatctaagtaaacaaactcttgtcatttttaggaaaaaattatctgtatgtgaatgcataaatgactattaattcagcttagtctgggagatgtggctaagtattgtggaggatgcagaaaagaatttggtctttgtattcaagtagtcagttttctgggacaaattcataagcacaatggcaaatataggacctggcaaaaatttattgcaagtgattagctatatgattacttagccaagtccagtattcttcacaaggggaatatttttagtaagacagagaaagcagttgatggactaagtctgtctgtctcttcaacttactcaatattgttacctacttctctgtgtggaatgaggtttgcttttgtcaaatctgatttattctgaacttggttatagatgcagcacaaaaagtgatgcaacaagcaagaaaacataatcaagtgaataaaagaatatggtaaaccttcctgtttgtatactttgaaagtattttccatagtaaacttggaagttgaaattggttgtattctgtgctatttagatagatatgactcagatttttataataatgtaaattttgaatattacctcatattttggctaattattagagagatatttgcagattttcccccttgtcagcccatctgctcctatggtacagtcataatgcggaaacattgacatctcaattatttccatggcaacaaattgatgtcaggatcctacatttaacttcactgcaggaccaaataggatttggattacaggggtgggttgggagctgttattgaaacataagtctttaagaaagggaaatagaaacattttgggaaatgtatttttcaaatttagacttacctttaaagaggaaattataaaaccacacatgaagtgaataaatgaatgctcttctctctttctatctgtaaaaagccaatgaaggacattttctttctctgtgatggttgcaagtaaaactttgaatctcatctaatgtttgcttaaaaaccggaaagacccaggcagttgtccatagtccaagttcagaactatcatacttttagtttagtaatgtatataaataaagtatatggtacttcaaccttaaattatgtaatctctgtgtcttttgtttagaatatggtaattatagttatcttatcttccatacttgagggactgcataacttcagtgtgttttggtactttgccttcctttttttatgtcatttttgtgctgcattaaagagtatctagtattttattagatactcctgatatggttttactcattttttttactcagggtaaacaattacatttgattcctacttacaaattttgttgaatctacaaatatttctgatacttttttgttctgtaacccttggtttgtaacttgtcataaggctggcctcatattcaagtgcatttgggcttctgcctccctggctggaatgtgaaggcaggaattgtgtctttgttatactcatagtacctggcacatagtgggtaatttaagtctgtttgttgaaaaatcttgttatgatctcataacaagagtttgtcagggcagattttcagagtatcgatgatgtcaccccattccactgctggatcttgaattttgcagggttaacattttgatttatctgttttgaggagcccgattcatgataaaacaagctgaaaagagactgacttatcatgaataattggtgataattccctggttctgtctattaacttcttttgatgactgatttcacgctgggagatcacattgtagattatatggctcttagatgaaccagccctggattaggtgttcctaaattaggtgttcaaaagtattgtgtttgctgtataaattgtgtctggacattttttctatccaggtacctgatagccatctctaggaggaaagtattttctaactcttaactgtgctggacaaataccaccagaaattgtgttcttctctcctctaaaatgactgtatatcttcaccctcccattaaatattacataagacattagagtgtgaatattacaaatgtatgacctttggtatccctattaaaacaagagggaaggagaggtagagaaatgggcactaacttgcttcaaatcgcactctgaaataagtggaggagttgggatttgaatctgattctggagtcaggtcacttgcttctgagctcatatatagattgatagatcatttctgaagtaggatatgctgcttatgctttaattttaactgttttcagtattaaaaggggagcgtctttccaaatttgagcatatctcactgtagcccctaagtgggaatgatagttttctacctgcaatatacctgctttcaaggtcaggaaagcagagaattgacatgagactaagaagaaaatgagtgtatttaatgataagaatttataatgagatttcaaatcagcaaatatacccattttggatctatttatttattttttctgtgcaacttaatagcattgcagtaaaaacttgctaatttagatgacttgtgggcaacacctgtttgaattaactgaaagtctgaatcacataataattttgtatacaataagttttattatttttctgatacataattaacatcatttaggagctagaaaaactaagcttctgagttacttagaatagtttgttttatatgctattaattgccttttaaaatatttaatattttctacttagagattgactctttgcaaaaggcttttatatacagccctacatttaatccccagaggaatccttatttttcagattagtcaatttggagtaaaaggagagcattaaaaaaatttcttcaggaccagatgtctggttatataattctatatcaagttaatatagctttcaaaaagtaaagcaaaatagctgagtaaacttatcatgagcagacccacattacaagaaatattcaaggatttccttcagacagaaggtaaatgataccaggtggaagtatggatctacacaaaagaacagtgctgagatgcctatattagtaaatataacattttttattaggtatatctctttaaaggataattagtgactcctgacaggtatggggtttctttttggggtgatgaaaatgttttggagttagacaataatgatggttgtaaatccactaaaatccactgcgttgtacacttgaaaatgatgaattttatggcatgtaaatcatattgcaatacaaataaataacaaatatttttaaataaggtattgataaagcaaaaagatggctggttagcattagcctggcctaaagcctgtgtatttgagatgtttcattattacatcacaaatctttgctatttagataactctttttaaattatcatcaaagtttgcttagcagcatctgaactgtcttggtctgctcaggctgctataacagaataccagaggctgggtagctgatcaacaaaagaaatttatttctcacagttctggaggctgggagatccaaggtcaaggtgccagtagatttggtgtctggcgagggccctttttgtggttcatagaagctgtcttctggctatgtcctcacttggctgaaggggcaagggacggaggtctcttaaaactaaaggttttgcccttcgctgaagaccgttgctgttgctttattccattaagggctgcaaaatggggattttcttattatatatccatatgttattgtgtattgtgtcttattctttcttatccatagagtgtctggaattaacttctatagaagaactttgctttacctgccagggctatttggttacctggaaccacagtttttaatggcaaggtggaagaattttcttccttatgtatcagttttcagcatactaagttggtgccctgcatgcatcatagttttcagtttctccatgtgattcttacatgcagcttgggtagagtagcaccaatgtagagcttggatacatcccaaattccaaagttttattacttattataaaagcacatttacagggtggctattttgtttttgccacattatttatcctcttgccaaactttatcagagcatatggatttctttcgaagcatttctataggggagttttgggaggtgcttccttatatttgttcatcttacaaactaaggtaaatgaattgtagaagaaacactccaaaggcaaccaaaaaataatgttaacatttgttcaggatttattttgtgccaggctttgagcttggccctttacaatcgttagcttatttaccctcataacacctcatgaggtaggtaatctaattcctaatgcaacagaagctaaaatttatctacttgtctaaagttatgggtccagcaaagggttgggctggagctaaggggtgcagacgttgggagatccagagcctatgcagtgagtcccaattctctgctcttctcagagtgggatatttcacatgtctaatcccattccccctgtagatttgtctatttccattctgagacaaagaaatggaatgactgtttgtaatattcagattctgccatgggaaaatggaaatatatacagttgtctacagtagtggtattttgattagaccaatatagctagcattttcaaagtggttataaggtgatggtcacaatgttatttacataccttcatgatagcatttaatcgctaaatctgcaggtcagctgttattaactctgaggaaataggcttaaggaaatttagtactcaatgtgacacagtgaagttggaaccaaagttcctctgactatgtagatctttattcttaatcacattatgctgactgggcagaggaagagttaataggaattaagagaggttggagagtagccatctccggaagccaatttaaggttgttttccatccaaaacaggaaacctatatagcaataacaacacaagttttatagaatatggcccaattaattacctcaatatgaaaatatggtcatatctctatagtgtgcttgttttcatttttcagttcctccctggtgttggacagtgaaagaataaggtattgactaatcatgatcagttcagaattttgctgtgatttttcaataggtgtttctcattatttggaaatgagcactcagtaaaagaccttgctgtgtcttgcatggtttgcctcattatgcttgtgggatgtgaatttaagaaaagtaagcttggattattttccccagcgattgaagcttaggttgtataggtatataattttaccatatcaaaatatttgataattaaaaccttataaagagaatgtaatgcatccctaaaagcccatttggaagggaagacacagtcaacaaccagcaacttattaactggggaaaaagtaccaaatgcacttgtgtatattttaagtgaaaagaagagaggactcggatgaccatgcttagttaagggggagggtgaccttttatatgcaagttgggaaatacagagaaagtgaaaggggaccaaaatgaaaacacatgaaataagataagcagagatgaaaggtggcactagaactgtaagaagcatttgaacaggcagaacagtgctggagactttaggagagggctcaagctgccatgtggccggtcctcaaatagttctagaatgactagcatatctttttacaaaactataagcaacttgagggcaaaaataaagtatatttatcttgcatcctgaagaataaacatggtgcttggcatttggtaggttttctttatgtgtatatatgaaaagcatattttcattttattagaagattgtggtaaaaattctattgaaaaccatgctataatgtagatagctagacttagttcggtggtttccaaactttttggttcaagtacccatttatgctcctaaaattgttactgacagtctaaaataacttaggtttatgtggattatgtctatcaatatttaccatataagaaattaaaactgagagattagaaaaccaataattaaaaacccattacatgttagcataaaacgtatttttgcaggaaataaaacccctacatttccaaaataaacaacaaacaaaaaaaatttaccgaggctttttttttaacatattttgcaaatcttcagtttctagcttattagaagactaaatttttgtacctcttctgcattcaatctcatattttgttttgtttgaatgtattaaaaaaactcaccccacacaaatatgtggttggaaaaaggaggtgtgttttatagacttttcaaataattgtgtatatccttcttttatactatgccaaaagtctacagattataatttcttaagagtttgaatcagaatctaaaactttatcagtgagcaatttatactctgttttgttaaaatagattggtgttttttgtagtttgggtggatcttttacctatgcatgatttggaaacatcatgtattggtcaattggaaaatatcaagttgctaagttatttagatgttccccacgttggcatatttcattatgtatcaaacaatcagatttttaatatcaaagtattttaagagttggaaagctgtcaagctcaggatggtggattaaattttttagtataccgtttttggcttaagagctcaaattttgtcattggcaacagacattgtcacttatttttcttgaggtgacaggcttactccttttctcattttaaacgttggtcatgaccacttgggaagagtttgtcttcagtgaatcagtcaagtaaaaatggcgtttcatgaaaagagtggctagttcagctcatatctcagtctcataagtgctttccttgagataaacaacccatcttattttgatatgcaacagaaatgctttatgtatactttccttcatcatacagaatattaaaatgacataacgattgtgattttaacaattaattttacatgtttatcaaagatattgtcaagtgaaactgcgttctatttactatgattgcatgtcagtgaaaagtaaaatgactgccagtaaaatttgttgcccctgccttagttcttgctaaaggaatcaacagttttaccaaccaagagtttcattgcaccatcagtggaaaaggtaagtagtgccttaatatgacgtggaaatggttttgacctcaaagaccccaggagggccctgagaaacactcactttgagtatccgtggtttggggcaggggaggttatagtgtacgataaagcaattatacttatatgtgaaaattattttggtatatatttctaagagtagaatttcttccatgcattagaacaagtggttttgtttaattggttcattaacagcttggataaattaaattgctattacagagaagaagataatttgtttttaattttcaaataaattgagtacaataatgcttcacagtgaatttcttaatagtgatcttgctcattgtcataactgtgtgcacatccttagacacaaatatggtttaagcaggtggcatacttttctccactgtcaaagtattaatatcatttctctgcttatatggttctttttcttttcttttccttctttttttttttttgttgagatgcgtcttgctttgtcacccaggctggagtgaaatggcgtgatctcagcttgctgcaacctccgcccccgcccccaacctgggttcaagtgattctggtgtctcagcctccctaatagctgaaataacaggcgtgtgccattatgcctggcaattttttttttttttttttgcatttttagtaaagacggggcttcaccacgttggccaggctggtctcaaactcctggcctcaaataattcttctgcctcgccctcccaaagtgctggaattacaggcatgagccaccgcacccagccagcttatagagttctttgtctgatttttgtactactatagttttatctcacaaagtaagcatatgggcaaaaacagcgtaagtgtgaatgtgttagacttttcagttactgagttaacatagcacctaattcacatgcaaatattatatatttattcctacccttggttaatagtcaatttaaaaaattgcaccttgggaaaaaaaaatcattgtttttacctagagagcagagatgagattattttattagaatttcttctaggattttctactgttgtattttccccttcatttttttatccaggtttccgttttggagaaaaaagcaacattgaagaatgaggtagagccctggaaaaaagtgtccttctaggtgtgttaagaatggttatagagattgatatcagataccatgagtgagcaaaatagtaaattctcataaaataatacatgagtataggtattgagctcttttaaataatatcaagtgatatagatgaaggaagaaaatgttaaaagggttttaaataagtctctttttcaatggtgtaagtatgagatttgtgaagccctttccagatgcatgtgtgtttgcttatgtttaaaaaatcacttgagtgcaaacatttaaacacattttataaaactggcgggccaggcacggtggctcatgcctgtaatcccagcactttgggaggccgaggcgggtggatcacgaggtcaggagtttgagaccagcctgaccaacatggtgaaaccccgtctctactgggggaaaaaaaaaattagccaggcgtggtggtgggtgcctgtagtcccagctactcaggaggctgaggcaggagaatcacttgaacccaggaggcggaggttgcaatgagccgagatcatgccattgtgctccggcctgggtgacaaagcgagactctttctcaaaaaaacaaaaacaaaaacaaacagacaaacaaacaaaactggcatggcattggacagtgacacataagaagctgatgtcatctttgccacttagagaaggcaaaatatcttgttagataacccctcttaaatgctctgcttggctagtactttttgggcttggtcagtgattagagtttaagttgtaaatggtattcataatttcttgtctctgtctcatcccaaacagattagaaaatctttgatttttgttggtaaggagctagcatcttattaatacaaagccttgtgcataaattatttccagtaattatttagtgcctaatgtggcatgctttgtgctgagtgctgaggataaaagaggaataaggtaagatctttatagtttagcagaggaggatgtgagtgggcagaaaaatgttatgagttctataataggaatatgtataggggaacttggttacagctcagcttaattgagaaagggtgtgaaatgaaaagaccaaacattctttgcagaacagctaaacagttggaattatatactcagatgagttaatgattataaatagccatcatttattatctctccagaactccagaaccaaggttataaaaaatgaatagttctttatttagttcagaagcatttgtgaagtatctatagcatctgtaacatggcaggccctaaggacgctggcatgaatagtgggccgtcatctactgggagagtcagtatagcgtgtacgtgcgttagaggtgaaatgcataaaggggcatccaacatggctggtggctggccatgtgaacaagacatttgcatttgccacagcataaagaaggatatttctgagtcatggagtattttattatgtttatttggccccaatatttccaaataaaaagaggcctttgcttttgtgctacaggcgtttcttatctttaggaagaatgggccgggcgcggtggctcacacctgtaatcccagcactttgggaggtcaaggcaggcggatcacaaggtcaggagttcgagacaagcctgaccaatatggtgaaaccccatctctactaaaaatacaaaaattagctgggcttggtggcacacgcgtgtagtcccagctactcaggaggcgaggcaggagaattgcttgaacctggtaggtggaggttacagtgagccaagatcgtgccattgcactccagcctgggtgacagagtgagactccatctaaaaaaaaaaaaaaaggcacggttttgaatctgcacactcaaaaatggccacagctttcccgctactttaagcactcataatagattaagcatgggtcagatctcaccactcattagctattgggtctgaccactaattatttagtggatctctagatcagttatgtaacatctctaaatcttactttcttctactgtaaattagagataaaaaaagtagccaactcctagtggttttgtgagcatttaatgaaatgatctatgtaaagtgctcagcatggtgcctgacatatggtggagacttgttatatgttagctattattattttctcttaaagtactttaataaactgcatataatttaatcctcagaataactccaaaattaggatttctcttatttcacaggtcaggtagaaatcttggcattctggcagggcttttcactaccaaccaagataacagcttgcttattcaaaccaggagctgcttttagtgttggtaatgatttcatagagagtgatgctatctttttttcattaaagtgggatgataaacattttcgtaccccctcaccatgtgcaaagcactgtgctaagtattttagaaataggaaacttgaaactgggatcatccttgtccttaagaagcttacactttattatgataaataagataaaaatttaagtaactatgcagtagaatatactgtatagttttgaaaagaaaaagtattacttgactttgtcttatttaagctttagatattctgaggggtaaaaaacacaagattgcagttgttagaaaagctgttttgagcatttttcccctactgttttccttagttttatttgcaagctggagcaggtattaaagatgaagtgttctggtgggagcggtagcccagagtgcttgaagcattgctaatttcaaaccttataatttagttaaattgaaacataactgcatttagatgaatgggctgctagttttccttcccaaagcaaacatgccaacctctcattacttcttgtctgtgctacggcttctgtgctattcagatctgctcgtttacacataattgacatgtaacagtgtcacagactttttattttgcagaaagaatttttaaaaaattaggaatgctttccatagcatgccgtatcaattattctacattttgaagtgagaatgacagagtgatccagaaacttggtgtttctgtggaaagcggtttgtacagtacttggctcatgcttttacagacctgggagtaagtgacacagtaggtctgattacaaatacagtttatcttcatttggaatccatgacttctattaaatttaattacttcccccgtggcttctattaaatttaattaattccccctgcagctggcatggtagaggtgctgctgctaaatgaaggtgattgctaattgagggagttttctgaaagaggttttaccctttctcttgtttatctggaaatcgcttatccagccagacatctgagaacattagtgagaagtgcaggttgcaaagtcataggtgagttcatcaccgttacttagagaatggtagattttttttttttctttttctcttggatctgattctgcagttaacatgccttttggtgagaggccagtgtaggattctaattgaagaaaactggcccagtcttaacctatacaagatggaacatgttaggtctatatacttggaattttctagcaaccctgtcgaggttaattgttgctcagtttcaaaaacaaaagaaaacaggtgaaagaattcagcatcaggagcagtttgttacccatccaatagccattatttggtggactccaccaatgacagtaagcagtcttattgttaatatggtttacctggtcatacagctataatgataatgtaaatatcactatacattcctaaggcaaaacaagaaaactcaaaacatttaaaaaaatcaaatatataattgccattgctttgcttctaaaagttggtcaaatattaggaagaaaaatgtatactgtaattagaactacatgcatttaatgcatttttattctcatcctttcatgtatatatgtaagtatatatatatacatatactttatatgtaagcatatatatactttatataaattacccagtctcagggaagttctttagagcagtgtgaaaagggactaatacaatagatgatgcctaaagctgaaaagtcacgaagcagctatataagcatattatacaaatatactttatatgtaagtgtatttatactttcatatatataaaagaaaggatgagaataaatgctattttatagtatttatataatatactattatatatagtatttatactattatatataaattatatatagtatttatactattatatataaattatatatatatatatatataaataaaatagtagagttgggggtcttgctattttgctcagctggtctccaactcctgggctcaagctttcctcccaccaaagtgctgggattacaggcatgagctaccgcacctggcccttttattctataatagaaaggagctctcatttttttgagcatcagtgtgtgccagaaattatatatatactctacacacatactttatatgtaagtatatttatggtattgtatataaatgtggaatatatgtacattaattttcctagcagtccaatgaactattttatacatgaagtgttgagactcaaattcttatcttttctctcaataatttcacctgctcatataaatggtgtgtgaaaatcctggctttgaaggaagatctgttgttctttgaatggacaataaatactcttttggcaacaagctccttaggaagctacttcccttttcttcataatttcatttctgttttttcttctacttttctggacattctgcttggctcaacctcggaagtcattatttcttacttaccatctataaactcattcattactctaaatttgttactccagtcctgacctctctttgagcctgttaaagaaaaccagagctgcacagtagttaaagcgataaaaaacagattttattcaggaactattgcaatagagggaaagagggctcagcatataactgggcttacttctgaatacagcatggacaagtggggatttatagccacagaagcagggttgggagtcagtgaatggaaaattactaagaggaaatctcagaggaaaaaggggattctggttaaacagacctaacagaattcttgctaaaggcaagccagggtggtgagatacatcacctggggatgggaatcgggggaatgaggaatttgatcagatgtataataggttggagggttctcactaaactgataagcaggattttgctaacattgggctattcacgtctggcattcttggggcctagttgagaaatgggcttagaagagcctgaataaattctggtctaggaaggctgggagtgctggctcacacctgtaatcctagcactttgggaagccgaggcaggtggatcacaaggtcaggagttcaagaccagcctggccaacatggtgaaaccctgtctctacaaaaagtacaaaaattagccaggtgtggtggcacgtgcctgtagtcccagctactcgtgagtctgaggcaggagaattgcttgaacctgggaggtggaggttgcagtgagccaagagcgtgccagtgcactccagcttgggcaacagtgtgagactccatctcaaaaacaaaagaaaaaaaaatctggtctaggagagtgtctctgtcaagccccggaaactttcactctttccatatctctatttgcttatttcccaggcatagcaaactgaaatcattacattcctgtacaaatatgtattttcttcctccaaccttccctgctggctttgactcagttagtgattaatatcagaaacctgggagtcataattccttctctgtctctgcctcaccttcaagtattaagctgtatttagtttaataacagatctttctactttattgcatttcaccccaacctcaccgttttagtctctgccacttggatgactatacttgctccctaatctagtgttccctcaaatccaggctccagacaacttgtacctttggattataatatgataattttacttttcttttcccactttgttcctcctcctctttcccctttcctctcttctttcctcctctatttttctagtctccgcatcccttattccctcctacttttcttcttctcaattcacttcctcacccctcttccctcatctccttcttacgtctccctcctccaggtacctggcagatagaatcataaagacttgtgtgtttcagtaatctgtgatgtggtgcttattactgatttagactgagcatatttaaagacggtgtactgataaccatgtgaaattccaagaaaattctgtttttcagaatgacctcagtgttcctgtctgctaccattttaaataattaatcttattgtttttggttttttttttgtgaagtgtactatgttatcatgttattttaacttgatttgtcagctttattttaagatggtaaccaattactaaagttctgaactttacagttctgatgaaagtacacatatgtttgcgcttcaccaatgctatacaaattcaaattccttttacaataaatcttagtttttcttctcaattagtcattaagtttcctgattattctttaactgatactgtattaatgtactggctatgttaattagagccatgaagatgcaggggtccatcggtgaatgaattagactttttcccttaaccctttatatgcctctatcctcagttgttctgctcaggatatagtagaggctgcatagtacagattgtactaccatttttgcacaagtttagtttgaagatacttttcgttatgtatgaagatgcacttttattctttggaagctcaccactgtgtgggagaaatgagataggtgtttggtagagtacaagtatacagggccagaaataattaggtatattttatgggcactggtggccagtttcctatataggagggcttatgggtggccatatagttgtaggtgggagggccatggacttgttttgaagctgcatttgataacatgcaaatgtttacctatttgaaaaatagtttacttgaggtgggtatggggtctaggaggaggttagatgttggacttagatccctagtcaatgctgatcccaccaccattgaaggaaaagaaggtggacagagataaaatgatgaaagagggagctgcaaaaggaggtaggcaatgaattgaaaaatgaggtgactgtggccccaaggctagaagaatttaacctgacagcgtgcagggaattcagggaggaaagtctacctgctttactccattccagaactatcttttgcatatttaaactttaaacaaatgtacaactctattcagaattttgtaaagaacattatgaagtattttgaagacatgtctagcagtattcatctttacttgtcttttctgatatttattcaaatatggagttaacacttgagatctgacttttgatgactcctagatcggtctgagtttggaagtcagagatctctggagatttagttttgattgttatttacatgttgggcttatagctactgagtgttggtgtccactgtggtctcttctgaaccatttttctaggctttcttttctgatggcttctctttagaatgatagtacagaccatttgtgctttcataatcttttgttattactgcaatagtgaccaaaaccagctgtctagctctctttcatgtgtaaaccattctgtatatatcgtcttaaattactaatcttttggttgactcttagaagtgaatccatcttgtgaatccttgtttgcggactgtgttatacttttgttagtttcatggaagatagatctgactcccaagcttatgtgtattagcttttttctacactatctagaggagagactagctggtcaagaatgaaaggccttaatgtaaggcctaggggagaggggacttgagggtgggccctggtccttgacatgaaaaccaatgctgtttgccaattgttttaattttctaatctttgttttttttttgattaataaaagagcacttcaaagacctttagacaaggctaaactatctctttgttgcttacttttgcccagtagaatgttctccccacaactgcctaaagtttccatttcacttcatgttttttcaaatagcaccgtttacagactaatttgggtgactgagtctccttagaaaacatggaatgcttttcagaggtttaagtggctacccaaaattcatagtgttggtaagatatgaaccatttacagaaaaggaaatataaacctttaagcagatttttaaaatgaggcttaataatccttataacaaagaaatgcaaattaaaatcataagaattgtcatttttttcacctctaagattgtcaaatattcagaaatttgatgtggctctatattagcatagattttggaaacagcaattcttatatgctgttgtttggtgtgtaagttggaacacacagtgtagggggtaatttagcagcatccatcaaatacagatggctgtatctaacaacaccttccctgggaatttattcaaaatgtctacgtacaagatattcaccgtggtattttttttttaatagcaaaagttgaaaagccactaaacgtccatcagcatggaactacttaaatcaattgtagtccatttatacagttgaatactctccagctgttaaaaaaattaaaataatgaggcagttctttctttatatactgatatggaaaggtcaaggcattttattaaagataaaaaataaaggtgtctgacagcacatatagtgtactaccttctattaaggagagaaatgacatatatttcttcttgattgtatatatacacacacgcatacagatatacatagaaattaaggatggattcacaagatactaatggcagcagttacttgcagaatgggaaaatttcactatattgcatttagtatgttaaaacaagtttttgaaacatacaaatatattttaaaaattagatttaaaaatcatactttagcatgagttaattgcattgtttcctttctaacactcatctgaaatcgggggaaagagttttgattgagaaagaaagaggatctaagcaattgcatagcattgaatccttagctgaggcaagctctcatccataacctaccatgaagacagtttggaacccttgagagataagaaattaagtagcaggagctttgcaagaaaatggaggtgaaaggatgccaaaggctaatttataccacagttgtctctgggtaaatatggggatttgttccagaacccccttgcccataccaaaatccatgtatactcaagtcctacagttggccccatgaaatccacatgtatgaacagttggccctctggatatgcaggttttgagtctcacaaatactgtattttctctctggtttggttgaaaaacaaatctacatatttggacctgtgcagttccagctctgttgttcaaggctcagtggtactttgaatattttctacaggcagctaactcaaagaaaaggaaaagatagggtgggatattcttctttcttgtctactcttctgcttctagtatgagtcagaatgtaaatcacaatcagaatgtgaatgtaaagtagtagcttggaattagcacatggttgaggtccattacagaccaaatatatttaattatttactctgggaaccattcagatgtttagaagtctatctatttgcaactgcattttcactttcagcagatgaattctcaaacttttggaagactaattaggggcagcatataattatcctcagggtcacagattgtcattcattgtaatcggtaggctttactccttggtgtttggactgtttttgtgatactttctctttaccccaaagcataggtttttgaattattaaaccatagcagaaatcatgaataaagcattttgaaggagattctattatctgaaacctactgtaattttttcatgcttgaattagttctatgtactaaggattattgtttcaaattacattagtgggaatagttttccatttttcttaatgaattattttattaaaaaatatattggccagactctgttcttgactgggtactcaatggtgaatcaaagtttctgcactcattgtattatttgtagtctttttggatacaggtgttatctaccgtgctcattcatagccccccaccccaccacttcagtaatttcattgtaaaatatgtgaagcaggaaggggaaggggaaatgcataactgttcaatcaattttgctcctaaatgtttgattcccatctaataaagaacttatgaccatttagtggaatcctgatcttctaagaaatttttccgtttttttaaaaacaattctttgatcactccaaagtactttctaagcaaatctcagtgtttccctggtattattccactgtttaatggaaagaacgttaagtttggagttctaattggaatactgatccatcactgaataattatatggtcattttttttttctctaaacttctgtttcaatgggaaagcaaaacttcttcccagagttgatgcaactattggaagtattttttgtgtaccaggagtactaggagctctctgtaaatgctgcccattatttggtgattaattcagaagcagctgatcagtaagagcttaagtagtggtactgtattcatcagtgtgttcaggtttcagtcttgcagcctgaactcctttgtctttaggcttttctcagcctaacttggcacctggggcagccctagttcactgtttgtatctttttgtaagttgatactccattgcatctgaggtgcacaacagctctttgattcaatccccaaatcaaaagaggtaagatgaaggcagatgaagagagctagaagtagttagttggacagaagtagagagatgaatgctgactggctcttctccatttcctgcctgtggcaagcagccagctgtttccttaattcaaaattctgtgtgccctggcagtgatagagtagattcttcttacagaattccctgctggcgattgccatttcaaagaagaaacttacagtagaattattatggtttagagtgttactgtgtgtataagagtaggtagaatgaagagccaagggttggcatccattcaaaagtggcacgcagaattttcatttattcctttactccttagcagaggtagagatgtcagtggaggtcacctacaggcaagactctctttgagaaacgtctgtgatgttaggtggtttgactgagcgaatcagccccaatgtatgcacagccgacccttgaacaacacgggcttgaactgcgtggggccgtttatatacccggatattttttcatccaaatggtgattgaaattacagtatcccgggatgggaaacccgtatatggggagaagcaacttttcggatgttcaggttcttcagggctgactgtgggactttagtatgcacggatttgggtataagctgggatcttgaaactgatctctcccgcctatgcgagggatgactgtgtcctgttaaccctgcccttctgggaatcgcgacagcttctggccgaaggtgggagctgtttcaattccacatattcacactcctcatagcccatttgctatgctatacctcggtacaccccctcatcagccctgcctatactgctattttgggtctgccttcattatttctctgcctgctactcatttagttttgtctcattctattctttctagcaagaacatctttattctacactctcctcctgccttgggtcagcttaattaccgcctaaataatcgctaaggctttggagtcgacctgtttgtttaaaaatgtatttaattatgtaatttatttttatttattgtggtaatgtcaccggaaaagggttcttgtcccagaccccaagagtgggttcttggatctctcatggaaaggaattcagggcgagtggcagagtatagtatagtgaaggtaacatagtttattagatactacttagttgcagagtagggtgtcctcagaatgcaagaggaggcacaccgccatttcaaatacaatgcttgcttatataaataggttttgatgtactcttttatgatggtttgtgattagcttgtggcaggctattaatattgttactttcttatattacgcttatctttaaagcaaaacctattctcaaactaagaatggtttttgttcttaaagtactagggcatttccataagttctgggtcttatacagttagttaacactattaacttagtccctcaaccatgaatatcttgtgaccaagagtgctgaaccccagggaaagtaacccagcagatttgactttttcccaccttcattcaagatggagtgactctggttaggatgcctctgatggtaggaatacttaaccatcataaattaaaaacacaagatttccctcttaaacaatttctaagtgcacaatacagtatcgctaactataggtgtaacgttgtacagcagatctctgggccttattcatcctgcgtaactgaggctttatatccattgaacagcaattcttgtttccccttctcttcataccctggcagccaccattctattttctgttcctatgagtttgactaatttagataactcaaagcaaaatcttatcagtcacagaaggacaaatactgcctaggttttaatccctttcctatccggtgatcttggcaagttacctggtactctgtgcctttgtttcctataaaatgggaggctaaaataaaaaatgcatgtgaagttctcagcatatcattttataaaaaaaaaaatcactcaacagtgattgttagcacttattatttagcgccactgcacctttttatttaagtcccataaataatctcaattgatgaaattagtgtcagtatatactgaaagcatggaaaagaaaagtcgttttagagaaagcagctttacaccaatttctaaagtaagcgacaatgtcaaaaattgtctttagaaactatatgtgtctctgaatattcctcctccgcaaaactttcaaatctgattttctttaagctccattaggtgaaatatattgtaaaagtttccttcagttggattattttacttgttagtatagttttaattgctattatggttaatttattattttccaatcttaatacaaatatttaaaactgtaatttaaaatgaaatttaaactatctaccagtcttttggggactatcttgagattttaaaacagtgctttggaaaaatgttggtcgagacccaaagagcaacaaattatctttttggattgaaaaaagggattgatttttttcatatcttttgttgctttacctgggactctcacaaagtgttaagaggtaaaattgttgctatatatatatatatatattttttttttcctctttctcattttggccagttgactgaataatttggtcaattagttgacttatttaattaaactacatcctgttataatgccaaaatgtttatttctagtatggtttatttgagaactcattttttattagaacacttttgatgactagaaagcacacaacaacttactttcattgtaatttttgagttggggcttttctgaaattttttgtctagcttcacccagggccaagctgttacagtcatgccttgctctcctgccctttattcatcatctctttgtgattcgtcccttaagagaagtctctaacagttctttgggttagcatttctctttcaagtaacagataacgaactgctttaagaccatacaccagaaagatagaaaactatcatttccttctcctttcatcagctgacccacattgttctgtgcgactcttggtctttgcccagcctcttcctcggtgctgtagtaaattcaaatttaaaccactggctagttatgttgagatgaattccatatcaagaaaaaagttttttttttaaattaaaaaagtaattccacattatttatgtcatcctcaaaagaccaactagtttaggggaagctgtttaattacacattcatttgacttacaattttagaccctgtcaggatgtccattgcaaactaagattttgaaaattataaagtttgaaattgttttaaaaaattgtagaacctatttgggagcatatccaacatagcattttcttgatttttgttataaagagagcacactggggaggctcacatgtgaggaatatctaagccagcctgcctgcctgcctgcctgcctgcctgcctgcctgcctgccttcctgcctgccttcctgccttccttccttccttccttccttccttccttccttccttccttccttccttccttccttcctgccttcctgccttcctgtcttacttccttcttgccttcctttctatgcctgcctgcctgcctgcctgcctgcctgcctgcctgcaaccttgacctcctaggctcaagtgatcctcctacctcagcctcctgagtggtggggactacacgtgtgtaccaccatgctcaacttttttttttcttatttttttgtagagacagattcttgctattttgccaaggctggtgttgaactcctggcctcaagtgatcctcccaccttggcctttcaaagtgctggcataagccactgtacccagctaaattcctttcctgaagtgaaatagctctatttattcaagtttattctggaatggaccagcataaaaaagattccagtactttaattttgatgcttagttttttttaactaattatatttattgagttctttgagtgccggacacactccacatttgtgctctcatttaacacttcagcagtaatatatgaggtgaattctatgactgagtaagtaaactgaaatttcaggagggtaagcagtttgttccaagtcatatggctatttagtgttgggatctgctctgccattgttcacagctatattcaattgccccgggtgttgtgtatctttccaaaaacgttgaaagggaggttcagaagtattcagttatttgtattattagtcgttttgaaactgagtagaaagactcatttaggaaagttccatatgccttcttgtctgtctatggctggtttgctcaggagaaaagtccacaattatacaattgtactcagagatcatgttatttgtatatctacctgcctcatcggagaggttgtgaatcgtcccagagacaagataatctttttgtttgcattcacctgggctattttggaggctagtttgtcatcttcctgcaggagtaattttatccatgtagttcctagactgttgtctaaatggaatcaagatgggtttgtcagccaccgttgcctaatggtgattttaggataaattatcttatctcgtattagcctaagaaatctctgacttgggatttggggtgatttaatacaaaatcattcaaagatttctttctgtcttttctttatggcttttggactgtgtacttatgactttctctgctgtgctcaagtatcttcttagtatctgtaagtaaaagttacttataaatgtctgtaaaaaaaaaaaaaaaacagtgttagaggctgggcatggtagctcacccctgtaatcccagcaccttgggaggccgaggcaggaggattgtttgagctcagggattcaagaccagcctgggcaacatggcgaaaccctgtctctatcaaaaatacaaaaaattaacctggtgtgatggtgtgcacctgtgatcccagctacttgggtggctgaggtgggagtatcacttgagcctgggaggcagaggttgcaatgagctgaaatctgagattgagccactgcagtatagccttggagacagagcaaaaccctgcctcaaaaacaaacaaacaaacaaacaaaatacaaaaaaaaaactattagaaatgccctggaataaaaagaatgaaatccggtcatttgcaacagcagggatggacgtggagttcactatggtaagtgaaatatgccaggcacagaaagacaatatcacatgttctcattcacatgtgggagtttcaaaagttgatctcatggaagtagagagtagaatgataattaccagaggctgggaagggtgtgtgtgggttgcggggtggaaagcggggatgaagaggggttggttgatggatacaaacatacagttagatagaaggaatacgttctcgtgtttgatagcacagtagggtgactatagttaacaatatgttgtatatttcaaaataggtagaagaattgaaatcttcgtagcacaaataaatgataaatatttgagtaaatatcctaaatactttgatttgatcaatacatattgtatacatgaatctaaatatcacatgtaccacataactatgtacaaaccttatgtattgatacaaatagttaaagggaattgaataataaagaataaaggataaaatatttaaactaatattaaaatcagggtaaaataaactatagctgcaaaatcataagacagttaagtgaatatacctggattaaggaaataaaatttaaaataatgaaaataccgaataaaaattaataataaaaatgtaaaaataaaattgaataaactacattgagttagggtgtgtgtgtgtgtgtgtgtgtgtgtgtttgtgaacacaacatacctgtatggtaggggtaacattggtttagattcactttgtacttcatacctgtgttcaaaagactcagctgagccctttgtgaggatattttgactttgaaaatctggaattgatgactcacttaaaatagttttatcttgggactgaaacagggacataggcatatttttgtatgattcacatcagagctgataatcttaatggtttgtaaagggcctaaatgattctacagttttatataaagcatgttaaactatcaaggctcattattacataactataaatggacagagttttataataagaaaaatgtacatttgtttagccattgtctcctaggaacttctctctattattacactattgcatttgcaaaggcaccaaaggtgcagtttggtttatatactgcagtagtaattcctaaaagatttaattgtatcaggttttttaacttaaaaatggaatcctatttaaagtatatccaaatattcgtacaataagaagttatcacagtctacctattttgtaaatgaggtgcagtgtttagttttcattggggtttttgattttctgttttgagcatttaaaacaaaatcctttgaaaatagtagttggtgatcacaatggtttatgacaattttaacaaattgtattagaagactctaaggagctgtattttcaaccgtgctttttctcttccttccttcctttctcttccctcactttttttcttcctcttccttccttccttccttcctttttgcattggggtaagaacataaataatattacatctttccactatgtctaaaaaagttggaggtggagaacagtatattttccatgaaaatgtcagcctgccacatagctctgcttagtaggcaaaccgttattcatttggattctctcttggctttacatttggaaacagttttagtgttaggtacttatgattgaaaaggagatctcatgttgagcttttattgcgttggatgcgcttaaaggaggttttgtaaaagaccattgcttcattaagaaaggaagaaagaaaaacaaacaattacatccagggaaatgctaggatttttgatagtttaacatgaccatgtcttgagcattttcagttcataatgaggcttgccctaactaaaatggcatttcatttcggttgatgtactcttgacattattggtgacatctgctaaattctaaaccatatttttttttaaattgatttcattcctacatcatcagctatgaccaccagttgagctggagagattggaatctggtgttttatttattaaaaaagacattttcagactgcttagctcacaaagatattttgtattctttttcaaaatatattttatttatcatggatgcttgtgttttaaggctgcatatttatttaaaatttatgaagaaccctggaaaacattcccaacacaatacaaagtccacacatttgcacaataattaagaatatttggccgagcacgatggctcatgcttgtaattccagcactttaggaagccgaggtgggcggatcacttgaggtctggagttagagaccagactggccaacatggtgaaacccgtctctactaaaaatacaaaaattagccgggcatggtggtgggtgcctgtaatcccagctactcggaaggctgaggcaggacaactgcctgaacttgagaggtagaggttgcagtgagccgagatcacaccattgcactccagcctgggtgacgcagcaagactccatctcaaaaaaaaaaaaaaaagaaaaaaattaaaaatcacacgttgactaataaagatttctttaaatgtttgtgtgtgggatgtgcttgttctttttggaagacactaggtatgttcacgtctccaggtttctccccgggggtgtgtggtgccagttcagaatctagcacacagtagacttcctaatccaaattttcctgaattaatgtctaatttttcctaatgtggcttgttttttgctatgaccaattcctgcttatatttcaacgtcaaaccttaaagtcacccttttgtgacttttcttgtttattattttttaaagcagaattaaatttttgtatgtgtgttttatacactctcatgcaagtgcataagctgcttcactagttatcatgtcctctctgtcttttctgctattattaaaggtaggtaatatattttagtctcattgcatcattagtacttagtatactctctgatatagaatgaacacttgataaattcttgttcaatcaagtaaagtcaaagacttcaaaagatgacttgggaggacaactagcatatatcgattttgtaaaatatgttaatatcttcattagttactttagaattcaatgcccatataatcttttaaataatcttgggagaaaggagacattatttctatttacagtcgaggaaactacggagttaaaagtacagaattaaactttctccctatctgtctcctgtcaaagctgtattaagctgcttcctgagagtttgaatttccatggttttagagccgtttctttcttaactcattgctaagtgacttggtggagtacaattttcaagactaagtttcttcccttaaattcctcatattgtataaacatactcattcaatactcatccatcaaggtgattctattattcccacagggaaccttttcatcatcacaattccatgtaaaatctcttacaaactactgaaattttcattctgatcttttataaataaaatttcatacctaataagtgaattcaaaaatgataaaatgcctatagtttaaaattaactttatattgcattgatgattatacaaatatatctcattatggttgatgttctctgtctatttgatcttttttgtaagtctctcaaggtagaaattatctaattaataatgcacacctcactgaattgagtaagtttacattctgagtcactaaggcaaacttctagaagagcctctaggattttcttttttaaacagaaatgcccctttaaaacatttctctgctctcatgtcttgccactggaatgcaatggaatgcattgtaaaaagatatatattttatagattagatgttggtgaagtttttagttgtcagattttactttgctataactttggaattggaactattacctttgttttattgcagtctaattagtaggacgggatgaggaagtatgaatctttatttttatcaaaaagccaagaaggtttttgtattggccattagctcagttgcttggaataatgtattagtcacctggaggtcataggcttatcacctggtggatgatagctttagtcctttctggagcacatctttgacatagcccctgtcagctctgtcaccagggaggcagggcaaggctataatggtggaagtacacattaattatctactttgaaaaagcaacttgaagtttagacttcgtgaccatagaattctaagaatttcgagttggaaggtaccttacggtcatgtgttcctgtccctccttttaaggatgatgaaattgacacacacataagctaagtgacttcccctagtttactagtagcatcacttggatttaaggccttacattttcttaacaaatgtgcagatacttcttgatttatgaagggattacatcccgataaacctatcataaatgaaaaaatattctaagtagaaatacttttaatacacctaacctaatgaaaattacaacctagcttattccaccttaaatatgttcagaacatttacattagcctacagttgggcaaagtcatctgacacaaggcctatttataataaagtgttgaatatctcatgcaatgtattgaatactgtattgaaagtgaaaaacaggatggctgtatgggtactctaaggacagttaatactgaatgtatatgacctttgcaccattgttaagtagaaaaattgcaagtcaatccatcataggttggggaccccatcggtactttagtcaggataggtcattgaaattcattctgagtattcatttgtttgtaggttagttaacttgttgatgtaatttgtacttgctgttagtttgtctggaatgactatttaccacagatcttcacattgacatatttcttccagtcatcctagttcctcctcagggaggtatcccctctagcactctgtatgacgttcctagatctaactgccattgcttgtggaacgtagactccatgaacatctcgttgtctttactgatctcagtatgcttagaacagtgtctacatttaatatatatttactgaacagttgaaagaatagataacgataggctttagaccttagtagtctactaatgatgtgcatctttagattgctataattgctttctcctaagctggagtacgatgcttagcgatggaagtcctactataattctgagcagctaattcttcagttgaagaatggactcggtcttatcgctgagtgagtaactccattgaattcttaggaagcagatttgtcatttcacagtgtccacagattctcatatgatttctcatttcactgtacatggaaaggatgatgccaaactttttttttcttttttttcgagacggagtctctctctgtcaccaggctggagtgcagtggcgtgatctcggctcactgcaatctccgcctcccgggttcaagtgattcccctgcctcagcctcccaagtagctgggaccacaggcacccaccaccatgcccggctaattttttgtgttttttagtagagacgaggttttaccctgttggccaggatgctctcgatctcctgacctcatgatctgcccgcctcagcctcccatagtgctgggattgcaggcgtgagccaccgcacctggcccaaacattttgttttatattgtcttgctagctgatggtcgtggttgatcctggctgtgtggaggctatgtggagggagggcttcaggagaagggactacttctggtgtggcagtcatccaggaattgaagacgatatctagctttactttggggaatacagaagtaatagattcattaaatgtatttaatgaatggattaattgaatcataaaaaagtaaaaatcatgttcatatgttacattgtctttctccaggaggacatacttcatttgtctgggaaggagcacagacattattgctttctgatattgtggcatatcttctgattgtcagcaatggcacaaagaagtgtgcttattgatagggttgataggagtggctcttcagccatgaatgtaactgcacagtagttcctgtgtacctaaatagaaggcaggcaagggagtggtgtggcttagagtttgggctctggagtcagactgcctggattgaaatcttggaactgtcattactggctgtgtgaacttggctaaattacataacacctcttaaagtattcttatttgtggagtcaataatagtgctttctttaaagaattgtgagggttaagagagagaatgcacacaaagcacataagcactctctggcgcatagagtggcactgagtgttagctattactattattaatgaatcaatgctagctccacacctttaacatgtgcctgttcagtactaatggcacgttagaacacatgatggggaactacattaaaggaagatcataatctttaaacttattcatgtgttatgttttgaaaagagaacttatgcctcaccagttgcagtgttggctgtgtggaagattccattatcaaaagactgaaattgaggagtaccaggaaaagtcaaggccctgaaatcttaagtcttaccagtttatttaacaagtgttccttggtagtttttacttgcagtaggaacattatatatttaatttcaggcaaatcaagaaaaaaaactttgtaagtcgaccttatgtagagacaaatgtttttgtttcacttttcccgccaaaacatgggttatagaaaagccattttaattacaaatgacaagataagtgaccagatgttcagtaaaatgttagaactacaaagtttttctttgaaaatgttacatcttgttcctacatgattttaaagattttaaatatttcattcattgttttcaaagcaaagagcatttgaaggagcttggtctgtgaaggggtcctgagagagttagaagaagttataaggattaagctatatttgaatttttctgttgggtgctgagaagaatacaatgataaggtccagatgatgcttccaaagggattataaggattgaataaaatactgtaaaaatagctttcatagaaaagtagaaagtgttagataatgaaagaaaaatagaaacagtgttctctgggagatattacttgcagctagagacctcaaggggagctttaaaaatgaactgatatttgaactaggcctagaaaaaaagtgaagttgataaatactaatacgcattggaggcacataagggaaaggcatcctcaacaaagtgacttgaatgtgcaaggactagaaatcagaggaataattatgggaagaaatcagaagaataaatatgggaagcagaaagtcatagtttatttcaccaagaatactagtcccaagagataacatgcacacagaggtttctatggtgaaattagttttggaaacattgggtactatatctgcctcctggaaatttttcaaacattacatattaaagattctgagcagtcttgtagtaaaaaaagtatttaatgttatttatgctagtttatttaattatgaaaccctctttttaagcaaaatacatagaaatgctatgaaacaattttttgccgatgcttattgggaaatgtaagcctgtaaaagtagatggagtcaaggtggtagagtgcctgaacgtcagagtgaagagtcagtgggtggatccatggaagctttctcatgaaagcttcccagataagtggatgagccatgatctggagactgtatgtgagatgggatggatcagagacctggaggagatttgtagggatgcatccaatagtaagtcttttttagcagactaagcctgaggtaatgttggtctaacctgggatagttgtggtagttgtagaagaaaagttatgaaaggaaaggagtagatggaattggggactattattctaagtgaagtaactcaggaatggaaaacaaaacatcatatgttctgattcatatgtgggagctaagctattaggatgcaaaggcataagaatgatacattagcctttggggactcggggaaaagggtgaggggttgtgagggataaaagactacacattggggccaggcacaccggctcacccctgtaatcccagcactttgggaggctgaggcaggcggatcaccaggtcaggagatcgagaccatcctggctaacatggtgaaaccccaactctactaaaaatacaaataattagctgggcatggtgacacatgcctatagtcccagctactcaggaggcagagacaggagaatcacttgaacccgggaggcggaggttgcagtgagccgagatcacgccactgcactccagcctggtaacagagcgagactccgtctcaaaaaaaaaaaaaaaaagactacacattgggtacagtgtacactgcttaggtgatggctgcaccaaaatctcaaaaatcaccgctaaagaacttattcatgtaatcaaacaccacctattccccaaaaacctattgaaataaaaaaaaaagaaaaaaaggaaaggaaaggaatatagctggcagttctttgatgttagttgtatgtggctgatacatggtttttagattcttaaatgtatttttttcacattttaacatatctaaaatcaggaagattttagcattagtgacagcatccttcattcttaacggtgcatgaagtcagatttactgaaatactgttgttaaggatgtttttgaggtaaagcaatacagtagcctgagagtgacttggggcttagcagtttctaacagtaagctcttcccttttctggaagagaagtgacactagaagagtatcctccagcctttgggccgaaggagatgctgatttggatcagagaaaaagggtgaatgaacatcagagccagaattccctcatgacttctgctgttcttcataggctttttgacctgtcagtaaaggagaaggaatccttctgaacttccacatcgcacttatttacttactagtctgattttatacgactgagaatagtgtaatttcaagcaaaatcttacttccttgagagatgtgggcttcagccttcatcttccagatattaacttgaccagatgagcaagcctgaacttcctgtctcaaaatgacttttccgcagccactattctttctctgcactatatctttatctgtagctgtaaaaattaacctttaaaacttttatttatttattaatgttttaagagacagggtctcactctatcacccagtctggagcgtagtgttgtgattataactcactgcagccttgaactccagggctcaagtgatcctcccacctcagcctcccaagtaactgggactacaggcacctgccagcatgcctggctaattttttttttttttttttactttttgtagggactaggtgtctctctgtgctgaccaggctgatcttgactcctggcctcaagcaatcctcctgcctttgtctcccaaagtgctgggattacaggtgtaagccaccacacccagccataataaacctttttttgcaccacatattatttgctatagttctcttaagagtcaattaatccatgttattttttattttttatgtactgtattttatttatttcttttctgagacagactcttgctctgtcacccaggctggagtgcagtggcgtgatcttggctcactgcagcctctgcctcctatgttcaagtgattctcctgcctcagcctcccgtgtagctgggattacaggcatgtaccacccctcctggctaagtattgtatttttagtagagatggggtttcactatcttggtcaggttggtcttgaactcctgacctcatgatccacccgcctctgcctcccaaagtgtgggactacaggtgtgagccactgcacctggccaatctatgttacttttgaaaaaagttcaaataaattgaaataagtctttactattatacattatgttcttatggtctaaagaactcaagaaatagttttaaaatcgagaacacacaaacacactcacactcacacatagaacctaaaacaaaactccccaaaacaaatatagattcaacaaaatactataaaaagccataaagcatattcagtatataatttttaaattgttctgacatatatgttgtttgtatacccgcacaaatgttactgtcattaaactaatgatcctattttcttcttctcaaaaaaagtcctagaaatctgtttgtgatggcttgatgaagtttagtcactttataaaaggttaagcttttaaaaacttttccttttttatttttagattgctaatgtggctaggtcatgagaagactctgaaaatagttttccttcattgctaatcgcagctgttgcattactaaccaatggtcagatcctgcattaagaacaagagactaaaattacaaatagtttcttctttttaaatcagagatgctggacttcccaaatttttgtcaggcagatatattcatgtgattttaggtgcttagaaaaagtttattcatggaaagagtttataattgctagagatagctgaacctattttaagatgactgtatgcccattttgagtttgaaccacatagactagggaatgaagaggagtcattttgaaaattttagcgttagctcagtatgtaccagtaactgaccaggttattatattagacatttcaacctcttcttcttttttttaatatttctaaacatcagaaatgctcaggttttttttttttttttttttttttttttgcgtccgtgaaatgttaaaaactattttgagttctttgggaaaaaagtgttctcccatgctgtaacaaatggaaccaataatgtgaaccttttgattacaaacaaagatcagactatttggaagggaaaaaaagaatatattggaaagtacatgggaatctaatgaagtccaaagatgaagtgaataataaacaagaagccatggagagctcaggaatgcagtctgacctctggaacaactagaaatgtgacacagaccccaatgatatcttcatctcacttacctatttctctttgtgtgttggctttttttcttctttttctccatgcagtagtatgaccattgagtttcctagtgattcagctttcacagtagttatatttgttgggagaaggtgggggagagtgagtttttactaattaaagataatgaaatcaatttacatatacccatgcatgtgcacacatgcagaaactaaaatattaaattcattccggaaataacaacaaaaataacatgctaaaaatgtgtgcatgaggaaaaataatgcatcatgaaaaattaaacataacctttcaacaacacactttgaaaatgcacaacacaaaaatacagttgtaggcagagggatctccctgaagaaatacaaagcagctctgttggctcctggttgctggccaggcctcttaggtggatgagcctttgtatgttgtttagcaatgtgtgtttcttatttgaatgggcctagcctcatgaatcatgaattgttagttcataagagtaaggtgttcttataagccaaaccaaaacattaacgaaacccaaatgctttttacaccagaaggattttaagaacacaattttagcttcttttagattgattgcggagcttgaagaaatattatttcatgataattccatcatttataatcaactcctctctgctgtttgtatgctgatccttgtaattctgggtaaaagagaacagcagtacattttgggtatattgtgtaaggtgggaagtggagaggtgttctcttgtgtagttactgagtccttccttcctgaaatgaatcgtaattctggaaaagtgaatacttgtgaagagtcgtcttgaatgatttgtaaaaaatcctgttcttatattcaacgagtttcgaatctttgtcagaggagtattaccattagattgaaaaaaaggaaaataaataatacacacttttaaaaaaactccccattctcttattctcacttttaggaaaagagactgactaatatcttctgccacaaataccgatgttcttaaaaatatttatgggactgcttttggcaaccagccctattttgttttcatatccctttttgctcccatctttccaaactcataaactcccaaattatattttccagttttattccacaaggtaagatttattttcccctaaaactttattgctttataattttaagataaaatattctaatacatttctttaccagttgatgtactaaaaatacagtgaatttttacttgtttataaatgacattaggaaaaatatatctgtcagatttgatcaatgttgattttaaacaacaatatggaaaagaatgattgtgttttttataagcaactagaagctaatgtaggaaagatgatattgatatttaagacatgctggcaaacaataacatataaatatcaagtaggctattttacctgggcacagaaggtctcttccaaataccaaaattgaatttcgtcattttatccagagttgaaattgattatactgagaataaccacttaatttctatctttatctgccactgttttttggttcaaatctaagctacatgttacactgttctccagatacactgtgtggctttttgtctatactgtccccaccactagaatgtccttcttcagctttagtttacaaaatctttcgtgatttattcttaatgctgtcattttcgtaagttcttcctgactgtaaatggcaaatgtaaaattcctgctgctctctaaatgctcacatcactttgcttgtactttctgttgtattaataattaccaccagttgcttgggttgtcattatttgtttctatgcccgggcttctccagggagctctaagcattctgagggcaatggcaaagtctcattcatcaaagcatgttccatatacctaaagtaaggtctaggatttagtgggtagtaattaaacatttattgattaaaaaccaacagttgattcacagattaaagaaggaaaaatagatattttagttttctgcttacaagaatttcaggcaaaattgtgcaaataattcagtttaccgccttgtgtttattttattgattaatttccctatgcatagaaaaaaggatcattccaagaattttaacctcattgagacaatttatattttttctttcaatttgattcagttatttgggatgactatttttctcgacacactatcgacaaagacaatgttccattcctttttggggaagaacaggtagctacattttaagcaaagtgcaaggtaggctgaatacactcgaaaaaagtttggaaatgtagtgatataaactcacaatatagtagatcttatacacattcagtgttacgcatgattattcgtttgctaggtgctaattgggctttagtactagacagctattatgaaggatttcctacctaactaaaccaacaccatgatcttccccaagaagaaagagttgatcttgggaagtttggaagcacagcttttggatcctttgttaccttcctttttggagggaagactttagaggaacagatactcttctcgctattattgcttaacagtttttttgttgggaacataaagagcatatgatcctcttcaaccccagaatcggtcttgccctggctccacaacactggcaatgagaggttcccagaacagcaagattattggaaatttaagttttaaacaggttctcagattggtttcctattgaatttccattctctgtcttttctttttttctttttctttttttttttttgagacggagtctcgctctgtcgcccaggctggagtggtgcagtggcgcaatctctgctcactgcaagctccgcctcccgggttaacgccattctcctgcctcagcctcagctgggactacaggtgcccgccaccatgcccggctaatttttttttgtatttttagtagagacggggtttcaccgtgttagccaggacggtctcgatctcctgacgtcgtgatccgcccgccttggtgtcccaaagtgctgggattacaggcgtgagccaccgcgcccggccgcattctctgtcttttcactttctaatatttaaaagaggcagctcaaggccacacttacccccttttagtgtccattttaatctttccgtggtctgtagtgcacagatttagtagactccaatatttcaaataatggccccatgccccaagtgttttccttacagctctgtagacatcatgtggtaaaacaaaaacattaaaagcattcagaaaccaaacaaaacagaatagctttggtgttaccatttatacttcatttgaattactggatactagttctttgtagacatttggaggtttctccgtaaagtcctgataagaattttcagaaaaggaaggcatagctcttaggtgactgagtatattggggagtagtgtggattggtgacacaatagagtgctttacagagctagaggggatcattacagtgaagtatttctgagcaaggataggcatcaaaaatagggatggaaaaaaagaatgatatagacaagaaggtggttgagataatgtcagagacaccctaagcaacacttaaaatttggcagaggtgtgattttttcctcagtttcccccttgctgcttttagtagtgttctggtgctgaggaggaggctcaggatctggatacggtggacatatgcttatggtagatgctttaggacagtggttcacaacctttctggcaccaggaactggtttcatggaagacaatttttccccagatgagggtgagggattggggggctggtatggggaggacaccgttccacctcaggtcatcaggcattagttagattctcataaggagcttgcaacctagatccctcacatgtgcacttcataatagggttcacacttctatcagaatctaatgcctcagctgatctgacacacgaggcagagctcaggcagtatgctcattcagccagtgctcacctcctgctgtgcagccgggttcctaacaagccacagacatgtaccagtccatgacctgggggttagggacccctgctttaggacatgcagaacaagtttgtaatgaggactgcgacctctaggtcaagccacatttttcctaaaggtaacattttatttggagtatttggaattttgaggagtgcgagggtggggatggtttgaaggaactgtgattatgttaaaaattaacacctaatggattttagatggttagacctttgtaataaatggaattcataaagcctagcattggcaaaaatacatatcaattttttttgacgagatacagtgtctaatagaatgttagcgtccatctttgcatctaaaataatttaaaaacaaataaattcacttgcacctaggcatttttactttctctttcatctctctgtatatgggtgggaagtaatgtgatacattgcccagaatgtgaagagtgtgagaggaacacacacaaagtggttgccaagaatgtgtctgggaattagacacgaaaaggaccacgttcctttttcttctcataccacgtaagattccctgtggaattctgcttgttcctcagggaggaaaagcaaaccatgagttcctggcaatattattggctatgagaaagttaaggaagagatactgagtgacaaaaataccatgatgatcgaacaaattttcttgttattaagcaaatcaaaatggaaggcccacctttattggctaattattatatgttagtgaagtcagaatgatttataatagtgatagacccagaaagaacctttaatgatatgcaaacacattagttttcttgtattaaagtgatctgtacctgttgacattattaaatgactcccatgctttccattctaacatgattgcttttgaatttgcattattaaccattatagtttttctatgtacaaatggtgtataaacttctctttggaggtgctgatatttaatggcctattcttgggaaaggttgcagggagaatattatgatccatagggcaattttgaaattacaattagtactctgttgtcttcctaggcatgactttcatagtggcttatcttgtcctggtattttaacttcttggctctcttattcctcacacataccgtgtatctttaatacttgaccacttgttaaaactaatgagattgttttgaaaacgtaaatgttagctcaagaaaaaaaaggaattactttccaaggcacgtcagagtactatataaaaaaaggggaaaatacagactttagataaaatgtcctactttacagtatatatatatacacataaaattatatagataattatctgagataactataattatatagtgatattacctatataattataattttataattattatatctatataattttattatatataattattatatccataaaattatgtgtatagcacaacaccaacagtagatctggttttaaacctgagttagtttagctcttcaccgactcttacccagactattgctatcacatcttcaaattttgtttttgtctctgtggatggccttctgcaatctatcctgtatactattgttaatgtgttaaaacacagatctcactgatgtacctcattacaaggcaatacaggatactcagcatggaataaaagccagttgttattgagtgttgtttgcctctccagttcttttttttttttttttttaagatggagtctggctctttcacccaagctggactgcagtggcgtgatctcggctcactgcaagctctgactcccgggttcacgccattctcctgcctcagccctcccgagtagctgggactacaggcgccagccaccacacccggctaattttttttttttgtatttttagtagagactgggtttcaccgtgttagccaggatggtctcgatctcctgacctcgtgatccgcctgcctccgcctcccaaagtgctgggattacaggtgtgagccaccgtgcccggccacctctccagttcttatcttagtattccaccttcaacttgatcctgcccatcaacaaagttaatgctgcattaatcgttaatcatgctgcttttgtactttttttgtgtgtgtggtggtcgtcattcttgttgcaaaaattagttaatatgtcagatcttctgtgaagtcttttttgaccatccacccaagtataagtacttattaaccatgtatcctattgctgcctgtacacatggcatatatttctcatactgtaattatgtacttatatttctgtagtcctgtttaggacaggcacttttcatctctgtattccccagattgagtgtagtactgatacttcactacatgtttattgaattaaattctttactgttaactaggtttagtgagctctgatgtcacctacaaatatattatcagccccaaacatttaatctcaaccatcaaaaatttagcacaaccaccatttttatcgtatatataggaatggaatttttttttaaattttcagttattttgaatagtaatttatttaagccttcctatgtgtcatggaccctgctggtttcaaacagattactgtgattgagtgaataaacatcaagaatcttttatagagggatttaatattattgtaatcataacgctggttggattagggtttgtttatcatgccattatcttcaacaaggctcatctgctgcctcttggattcagatgctgctcagtggctccagcctgttctctctgaagagaggagaacttaacaaatggacattatcctcaagagtcatctctgccagagggctttgtggaagtgatttgtgagaataattttttttttttttttctcactgcatatctcaaatggcatgtttttcaccactgaaaataggaagacagttcttttgtgtttattaaaaataatagctaacttattcattaaaagaaaaagcattcttaattgtggcaatggttttgtggctttggacattaagaacaagttaaatttttatatgattcctcatccagatttttctcaagattaaaaactaagattcctagagaaaaacatttttttctttcaattttcacatagaattcttgccgttggagaattctgagatcgttgggaggaactttgtacagtgatctgtagacaatagctcttgactgtctgtgttttctgccaggttgtgtgtgattttgtaatacttccctagtctaggccgtatgcttctgaagagtccctgccatttcttcattccgcgatgtcattaagacccctgttgcttttatttgaaaagtatacaagctttggaatcggataacatgtttcagttcaccaattaatagctgtctgaccttggccaaatcaatgaactgttctttaaagcagttttctgaggtgtaaaatgagaactttttcattgaccttgtttgtaaatattaaatgaaattgaatgtttatagtaaataaaatgttaacattttatatcaagtgaaaaaatggaaattaatattcataaatattaaataatataaaacttaaacacttgtaaatattaagtgaaagtaccacctacagtctgaacacataatatgtgacttaataaaaccgtttaggttactttatgaagcaagcatttggtttcacatattctgtgtaccacacttagtaaagcttagcaatggcatcgttacattagatcaactggacagaacaataaaagaacaaatctcctccagaagataaggttttacaaataagtagtggcaaggcaatccaacttctcacctatttgattcattttttaaaaatttaggtgaatgatatacaatagctgctctctttaaatttttttcactctgaggttatttcagttgtgcatactaccaaaaaatatttaaaaaatcaaatcggctgacagaggcaacttgaataattaaacattgcagggtggtgtgcaacagggaaagaactgccgcactaggaagaaggggtcccgcgatggagacgctcatcatttactatgagtctgagaaactcagttaaccttagagaatctggggtgtgaaaggaggctatgatacctttcctacctggagatagggagctgattcaggtaaaatcttgacattccttcaggttctgaaactctaatactaggagttggagaaaatgtggactttttctgtgagtatctatttactattataagtatatttaggatgaataggattgtgccttagagtttggggagtatcacagggaatttgttgctctactcagtccttcttaagggctgaatgaatctacttttatttttctcccagttgtgacccatgagctatcagaatcccagtactatagtttctcttttcttttagtgatttattaactactgttagtctttttttaatagggttattaaggtcaattaaatagtaaggaaagagaaaacttaagtagacattggtttgagtaagaaaaaggcaacagaaataaaaccatgttttgaaaagttgggtcagtataggaaggtaatccttataaagtgatcattctaggtaggcatcacatttatacacccgtggacttcttactaaactgacctagattgtggtgacctgtgcttaaatgattcttaaagtcattctcaattccgatttccagtggttatgttacattcaatagggtgtagcctttggaaagatctaatttctcaaatgtgccgtgccattccatctgaatagtccagtgatttcaaagacaccacggaggaataccattgatatcacagaagtcctgtcctttcttaagatgaagagtatgaaaaatatccaagcagatgcagagaggccatctgtcttgagactctagaggacattcctatactgggtggagaattgtactaagtgggcttgggagtctttcgcaactcctcacatttgatttttttttttcattttaaataaatgatcatttagaataagtagagctctgcgttttccttgaaaagtaggatggaattcatgaaagggaccagcgaatgttctcttatgccctggtctgtgcagtactctatgcagacagacacttgacagatacccttgatatttcctttctcttcctttgtgggattgctttgaactctgtaggagacagtttagaatataattgccttgtcctgctttagggatatgtaggcgggcttaaatacagatattctcaaatagctggttctagtaaactaaatgcccttcctgaggaaatatatgggttgtagatgctgaaataaactaggttaaaaatatttattacacaaaagagatgctaactgaaagaggcacacatccttgttctcccaacagtttctcacttgtaaatggcatctctaaagggttgtccaaattcctagtgtgggcatgtagagtagacagctgagtcacagctgctgaaatgagaccatgcctccctcccgctcgtgaagggaagaaatagggagaaaggagtgcaagagaattagtgccaacagcttacttaaaattcactggcttgagaagtctatgagattcctgggccaaccggaagccattactctaccacgtggagtgtctgaagcatgaaatctgcctttccttagagaactcttatcattggccatagtttgtacaaaaatgtatcttctttctgcagagatctttcctgtattgcaggaatgctagtgttctctggcctatcatatgaggctgctggcctaccattctagtttgcattttcgacttggtgatacctggccagcatgttggctttctcctgaagtttgatgtttctcttccccttgcagtacatatttgaaaagaagtttggaactgccagctttgcttggatttgaactatggcttggtgccttactagcaatgagaccttgaacaaattactcaagctctctctaccttagtttcctcatcaataaaatgggaatgataataatgcccaactttttaggttgttgtggggattaaataaattgtttcatattaatgtaccccccaccaaggtgtggggattaaatgaattgttcagattgcttagaacattgcctggcttgtcgccactctgccatcaatggctgctgaatatcctgtattggaagtagcattgaagatgattggaaagagatattaatttaccagcaaattaacactccatctcatagaaagagcactaataaattaagatctgctccatatcaccattactaatattgttttagaattttttatggatttaaataattttacacacatacagaggaaaacaaacagtattatttagacattatgaatttatacttagaaggcccagtagcatcaattgtaaaattactagatttagatcattagcaaaatatttgagactgcaaattttcaaaaagaggtgacttttccaaatatcatcaataaattataagaaagtataatgtgggaaaggctagaaataaatataaaccaaaatattagcacttactacttctggtttttgggaatatatgtgatcttttaaataaatttaaaaagccctattgtttacgtagtatttactgtgtgctgtgaactgtgttaagtaatttttgtattttaaaaatagctattggctttacacttcatttgtgttctgaccaaatattttcattagtcccctttgagatccataaagcctttctgagttttgtgaatgtaatgcagctaaagattataattgtaaaactgcattccaaatggcacgtattgtaatttgctgctacttatatctgcttgaagctgtcaatatgtagagaatagatttgatcattgaactgaagtaaaactgctctcaatttaggagtgaaaaattttaaggccccacctactttctctctgggaaaagatgtttctgttttctgtgtgtgtttatattttctctatttaatgtagatagtaatgttgactagtttacatctgacttttcttccaggtaacattgagatttagaaaaagtacaatatggctggcaccctgagtttttggagagcttaactttgtgtccgaaatgcttaagaagaggagtgtgttcatttgctgtggttgtgattatgattataaacttaaggctggtaggccgggtgtggtggttcatgcctgtaatcccagtactttgagaggctgaggtgagtgaatcgcatgagctcagaagttcgagactagcctgggcagcatggcagcaccctgtctctacaaaaaaatacaaaaattagccaggcgtcgtggcatgcacctatagtcccaggtactcaggagtctgaggcaggaggatcacttgagctccagaggttgaggctgcagtgagccaagatcgtgccactgcacttcagtctgggcgacagaacaaagaccccatctcaaaaagaaaataaacaaacaaacgtaaggctggtaaggaagttttgccactgaaggcccagcctcagccaagttagtgattgggcaggaagtcagctctcaccctcacttaccctgcagttcccctcccctgtgacttctacaccagtattttatagtactataaagttttctttgactcacacagttctcacttcacccttggagatgcagttaatgccgttgagtcagattcagtagactttcactcattatgctgttagggtctttaaagaaatcacagatactccaatttaggactgcctgttgtggaggttaccacagcccgatgcaaggccacatgacaaatcattcatagtgatttttaatgttttggtagaaataatatttcttgaaaacatgactatgttattgccaatatctgcccagcaaaaagtagtttttgtctcttttacaatatgctcagaatatatgaaaaacaaatcttcatatgaaacatagtcaatcctttttatagattgttaaaggggactgagggtgaactgcagaatcctataaattggatgattctcgttttgtgggtatatttacttgttgagctgatcgcagcagggagagggtgcacatatttccttctagatacagcagtccttcactggttggaggttaaaagctgttgaaaaataacccgaatgcatttcatgaaagaatcttagacaaatacaattacttggaatatcagctaattgcttgctctataccatgattttcatgtcttacttcctccagcctgacttcctccatgtaccttcttggtctgagtaaaatctatggtaataaccaaatcgtagactaaaattaatcataatggtgagggctaaaaggaggggttaggaaaggacttgaccctggatggtattttcttatttttcttagtacatttaacatgtgtattagtccattttcacgctgctgataaagacatacctgaaactgggcaatttacaaaagaaagaggtttaatggacttacagttccacatggctggggaggcctcataatcatggcataaggcaaggaggagcaagtcacatcttatgtggaatggcagcgggcaaaaagagcttgtgcaggaaaacgcccccttttaataacaactacaacagcatgggaaaatcctgcctccatgattcaattacctcccatcggccccctcccacaacacctgggaattcaaaatgagatttggttggggacacagccaaaccatatcaacatgtaactttacaagttgattgtattgtagaccactaattgaaaatgctatttctaggaacagactttattttactaatgccaggctatgagtaaaaatgttgaattaaataatgttatgagtaatagtagctaggtagtcacagtcatagttcaagcatttcataatgaaaatatacatatttacatcttctggcaaagttataaacccatcccttccagataaagcagcatcagaaatacttatgatgtgtctacctctattatacctaatctattttgcattctgattttatcttcagaaaaggcctgcagttactgaaatgacaagtgaaaaggaggtaagttatgtaattagatgtcaggagaataataggaagttatagccatgttttagataagtttattgttggctgacttaaaatgctattggtgtaatcaatcttttcttggatagcttatcataaaatgttgcttcccataagtagtttccctgtgtttattttcttaatccactaaattgctagctgaaacagttcgtggctaggaagggacacttttatgtcacatatctcctatgacactgtcttctttccatttttgtaattgattcaacatctctttacctctgtaacatatttggatctttttattctgtcagcatttggccaaataattgctagatcctatgttgtttcttaaaatatgctttgtcttaatcaattgttgagtatttagattctccacatgaattgactatcatgatatcttactattattcattagtccaaagtttgagggtatatttgcaagccattttgctctcagtgcccttcaagtctgttctttcaattttttcctatagccattgggttcatctaaaaagacccatagacattttgcttttgcttctagcagtattggtagccttagcttgtatttgtaggactcaggactaaacatatgccaacaatttatgtagggtagaagtgaaaatgctggattatagggcaagtatattaacaactttggtaaatgaaaccaagttgccctcaaagtaccagttgtcctgttgttatctcctctatgatcaatactacatattgtcaatcctttgcttttttgcaaatgatatagacaaactcttcatttttgttgcaatttgcccttactcgaatagtgaagctgagagatttttcctgtttattggaacattaattaggggtagtttttgtttgtttgtttgtttgagagagtcttgctctgtcgctcaggctggagtgcaatggcacgatctcggctcactgtaacctccgcctcctgggttcaagctattctcctgcctcagcctcctgagtagctgggattacaggcgcccgccaccacgcccaactatttcttgtatttttagtagagatggggtttcaccatgttggccaggctggtctcgaactcctgacctcaggtgatccgtctgccttggcctctcaaagtgctgggattacaggcgtgagccactgtgcccagccaggatagttttatttttaataattacttgccaggatgtccgtgtcagaaacacattgtaataatttattttatctatttttagtgacttgaatatttcaaaatataaggtatggcttgagatgagaagtgagtcatgaaagctataatactacagagaagataccagacttcaaatgctatcttcatactgctagtgctttaatctattatgcaaatcatatttgccagctttcttcccccatacttgaaatttaaaaacttcttggtttttatattttattctgaagaactgtgttcacctttttaataaaccttacaatttgatagattaaaacttggtcattatgttttagagcaagggctggagggaaaattgaaagaatgttgaataaatgagttttataatactttagtgaatcattttttctttcttcttcttcttcttcttcttttttttttttttttttttttgatagggtcttgctctgtccatcaggctggagtacagttgcacaatagctcactgcagtctcaaattcctgggctcaagatatcttcccgcctcagcctcccaagtagctgggactacaggtgtatgccactcctcctggctaatttttagaaatttttgtagacatggggatctcgctttgttgcccaggctggtcttgaactcttaggctcaagaaatctaacccctctgtcttcccaaagtgctgggattactggtatgagccactgtgccaggccccaatcatctaactctgatgagatcagaatatttcaagtttggagatcttctcatatgtactgttcttaggaaccacgaacttctgatatactagagtttgaagcaaaagaaggttcacttcttatctccattaaattattgcctgtgggttggacaagcttgatctagatgttttcctaactaaaatactaactaatgatgacttaaatgtacacagcacttagcttctaatatcataggatattgtggagaaattttcaaattaattgacacacgtttctaagtagtagttggaagcagaaattggagggagtccaaatagtttctttgttggtatagaaatgaacacacacacacaaacctgaatcttggtgagatccaatgtaaaatttcattcactattcccccctttaacactgtctttgttaggttagaatggccattgacttacatgtcacttaaatgtctgtgcaaagcagtgctttttgctgcttgggaaatctttatgtggtgattccactaaatggtaaccatatgcactcaactgagggaggaaatttgaggagaaagttactgtgattcaggtttcagcattgatttggttagaagttgacacctttaaagattatcttaaaagtttcactaaaacttcccttaaaacccagagtgctgtctttatgagaaagggagcaaaggtccccgacatccagggttctgatgtcagtcaacattaacaaaatgatttgcttgtgtttgtgtgagtggcttgtttgctctggaccagacagaaggctaaactgtcattaaattatgcttagaatgagaagaactggttaatgtatccaatagcaatagttaatatactggttgtaatgaggatgatatccaattatctattctaaccaaagaaaatgacagaaaaaaaccatcattctttagtcttaagaattgtgttttaagaagtttgaaaaacccaaacattggcccatatgccttctatgttaacctagtctagaaacattttgatatgcaagggggttaatattaatgaaaaatataggaagataaagttttatatatataattattattattatttttgagatggggtctcactctgccacccaggctggagtgcagtggtatgatcatggcttactgcagccttgacctcccaggctcaagtaatcagcctctcgggtagctgagactatagtcacgttccaccatgcttggctaatttttttttatttattttttgtagaggtgggttctccctatgttgcccagggtagtctccaactctgggctcaagtgatcctccttaaaaaagtgttctttttttttgttttttgatttcaagatgcattttaattatttacataaattaattggttatctattttcttgaagtgtatttcaaagtcctacaaaacttaattgttgacctccttaaaatgtagttgagtatacttaaatttcctttgccaatctgaagtaaaactttaaattcaaaccctcaaagcaggtctttgcccttcctctaggaggttgggtcacggaattctgttttacgtcccttcataaaaaaaaagaaaaatgatctctctcccatcatgcttgagctaagtcaggagcaactgctgaaataagccagtgtgtgtctcatatgggtgaagtggagcccaccagtaatcagtaatctctccaggagaaacaaaacaaaacaaaacaaagatatgtttaaatgtgagcttgggtggtttccagttttaccaaaatgtaaatatggcttcagttgagaattttatttttcagtacatttactctctgttgctttgttcgatgaatttctctagattgtgtatctaacactaagtgaaaaagaccttttactggaatagttaaaagtataaaaaataggaaaagaaacttgggtaaatatactcactaatgatctttgggaaaacacctggtttattatcctacagtttgtgcaagggctactgcaaaaatagtccgaacaaaattgcttttaatgttttcaaagatagaaaattcactggtttatacatgctttagggggaggtgaggtgaaaagggaaggttgccaagcaagagtgatagtatagtgttaatgatcatataaattttcagccttaagtcaccctatttaaataaaattatttgtagaaattttagttaattagctaggcttttatagctttttctattaaagaccctttcctgtcagtgatatcagggatgcctgagagacgttgatatattatatggttcaaagtttaccacatgtctattctcataggatgcagcatcatcatgctaccaaatggatggaatggggaataccttctcttgaggttgtgcccattggaggcagctgtactggataattctgaaaatggctaatcctgcctcacttttaggagacacttaatgtagtgtttaagagtaaagaacccatagtgcctaggttcagcccctggctctggtactttcttgctctgtgactcttggcaagtttcattttttcttctttggggtacttttcactaacatgttccttttacattttcaaaacctcttttcatctgtgaaatcatttctatgggtatttggcatgtaattaattacccattagctccaataatgaggttggatgaagtcacatacttattggcagagctgcccaggtctcagaggcttatttttgaattccaacttgtacctgagagctaaaaattaggtaagatttggattgatcacacttcgggatcccctgctacaatggatatgcggttacctgtatttaaaacaaagaactgatgacctttttccttttaatagctgattccttgatttacctaactattcttcattttatttcatttatggaaagagcactgaactagtgaagcatagtaggagataacttgcacgcatgtatgcatgtatatgctagggcatgaggtatttcccactgtggtcttacaagcttgaagcatttggacggaaggcccttgaaagtgtctctagttctcaccttttctagtctcactttattactcatactgcttgccagccaaacaactgatttggtttcagatgtagcactatcattctccatttctggttcagttgcttggctgtggctcaccgctactcctcttaatatgtgagaaagaaaatatggaggtgatgcagaagttaaaggttcttggttgtaagcttttaaccagactatgttctgcctatggtttaagatcagagtgatctaaaccaagggctggtgaactttgggccaaattcagactgtggcctgttttgtgaatagaattttattcaagtacagccatagctatgcccatttgttaggtattctttgtggcttcttgatactatgacaagagttttgtagttatgacaaaaatggcatggcccacaaaactggaaacatttactaacttgctttttgtacatgaagtttgctgactcctacgctaaaggaaggtatttcctgactgtttgaaagtatatatgatgagtgttcaggtaaaactggttttggcaatatggtaatattgccttcatataaactatttttagtctttctgtgtatattagatggaaaccatatttctctttttgttaagggcttagctgttaaatatgtgcatctgtatagcatatagagaataaactgggaagaataaaacatgaaaaaataaggatgcttttttaaccaaaaaaaaaactgtgttgggtgttaggagcttgacatgcattatgactaatcctaacaccactgtgctataactgttattattttgatcgtactggggaggaaattgaagctaaaagaggtaaaatatgaaagctatttatgtatttagccattactccaggctgtgtctagatatattgtctctcttctattacctgcgtggatgatgtatggcccatacttaaaattcttaagccttattcatagatgtataagggattttaatgttgtttctctgtaaagatgaagggggtggaactgaacttgttattccattctggataattcagtcttattgaagattgtttatttagttggagtggagcatctgcttcgaataatatacagtttgaatagaagtcttactagctaaataatcttggattatatgaacatgtattcttggctagagatggaactcaagggatgaacaattagataagtaacaattgtgtttgaagtgagttcttctgtcatcattaagagttatttctacctatcaataaataatgggtttggatttcctgaaatgtgtctctagttgtttttccttaatgaaggagttagacctaaataatattttcacaccctaattaactacaagcagggcaaaggatactttcaggatctcaagtgattattatttaaagaactcctattcataaattttctgttttcttctagtagatcctctttggtaatgaaccagagcaatatattatgaccagtgactcataaatatgcccttaaaaccatttgttacttgtatctacttggaatttttcctattttaatttcagtacttaaattggaaaacaaaagtgttgcttatcattagagcaggtataaagtacctaaatatttatcacggtatgccagtttttattttgtaccttcagtattcccagaagtgtagcgttaaaaggaaaaaaaatgattcgcatatcccagtatatttcagaggaaataggaactttatttaaaagcattaatttctggctgggcgcagtggctcacgcctgtaatcccagcacactgggaggccaagacgggtggatcacgaggtcaagagattgagaccatcctggccccacatggtgaaaccccgtctctactaaaaatacaaaaattagatgggcatggtggcacgagtcccagctactcaggggaggctgaggcaggaggatcgcttaaacctggaaggcagaggttgctgtgagccgagatcgcgccactgcactctagcctgggcgacagagtgagactccatctctaaacaaaaacaaaaacaaaaacaaacaaacaaaaccattaatttctatacttctgtaaggtgtttttctgggaataaactgtattactcagattatcaatagaactgcatttaagatatttagtaattttcattctttttacaatttttgtgaaatatattggcttttttgtaatgaattttgtagatcatatcaacaaatttatatcatggtttctgattagcatagatagatgacaaagttagcttaactcagtattgcatgtgtcctaatgtgacatgtattaatctttctctgtgtcctgaatggaagaaagatcattccaagttgataatcacttacatgagcaaagttatgtatcacagcttaattcacaattggagaaggttaatttgtccatttttgaggatcatcaagcagctttactaaggatattgtattttccaacttattttgtcttggactttctttttacttgaaaaaactatatatattccaaaaatttaagaaaatgcttcatatcttcagctaaataaagcttgttctttacaaacagtaaagaaccatgaaagataattctatttgtttcttgctactgtactcagtcagaaaattaagaatctagaggtgccatggaggggagagtgtggaagatcttaggacaataatcttttaaaagaatgtccttcatggctctccagtgatctacgacttttcatttttcttcagttcaactttgtttaaattaacgtgaccccaggttttattgaaaagtttgacttcagaaaggacttaaatttagtattcattttttcctgattctacagaaaatgtctctggttccgtgttctctcatagagcttttaccctctgtttaaataagcactcaagaatctaaatgctagatgtttaggcaatatagttttggggtcaggggtacttacttttctttcctttttatgtttaatctttttggtgtctaatactacttagtaccacatttttcaccgagcagtttcggagtaaaaagatattctggcaagttcatatcagcttgatttttattttcagatgaacaggttgccaaccccttaagtggcttgctatcatagaaacagaccatttcggtgatagatctgtcccttagttgattgattggcgtagaggaattagcagtctgtgaaatgctcttcagaagtaattttcctccaaaggtcaaggaactgtggtcaccatttctctggcatgatttgcagctactcattgtagccttattaccagtagcaaatgaaacagctgaaatggaatgtttccttgctcatttttctttccctctgcctaactaaatttcttgaacaccagtttggtattacctctttctgttctgccatctgccatccagctcagtgaaactttaaattcataaggtatgttttaatttatgaattaggagcttgctatgacatttctctttttaaatagatttatgtaatactatacataaagatgtcttgaactcaagaacatgtattgaggaccacgtatgatagaggacttggtgtttaggcctttctagtgagtcctaaatggtcaataggaactgtatatgatggaattagttcaggatatattatgcgctctctgttacaaggttgaaacaaattattttcctctgtttccctctattcctcttttaactcaacatgggttattaccatttttttaatgtggcttgaattgcctcatactcttggataaaatcttttaaagattttaatacagctgtagaacaaactctaaactcctttttctgacatctaaaacttttcgtatttactttcatttcttcctagtttcctatgtattctggatgctcattatacagagttatttgaaatttcacaacatatgatgttcctttagagttatatgcctttgatcttgcttttcctctagttttattcccatttccattctggctttgctctgtttggtatatccttcctcatattcactatgagtaactcattgaaaccttccctaaccaaccctggtgtgagtagccaattctttaatgttctgtggaattttcatcatattattatcccgcataacacattgtatttattttaatatatatgtctcccatagtttgtctcatttatcagtccagttatttttgcatttcctatcatctactccagtatactgtatttgcccttaaccttgaaatacaaaattctttacaaaaaaatttgtaaaagttttattagtatgctatattttatgcctcttggattagaccttgttgtaaattagaaattaaaaattatttaaaaagctttcttattactcaagtcaagtagaccagtaatgattttcaagactcctttgacaaatttcagatagggaagggatgtgcaacaaatagcaagcattgacccacttattttgtacagctactcctagttgttattgctaatcagaatcctgtagtctaaaattaacagtggctatgaaggagagcaattaaggccatttgtctttcaaatgagtcaatgtgggtcccactggtagtttaaatttatatacagagggcactcacactattataaagggtaatgggggccctgaaggcctgtgttacaaagcagtaaattattttagagtttgatagcaaattatattttgagaaaaactttcctcttgctatgtgaagatacatttcctagcaacctattttcattggttaattttaaattaaaaagtacatcttttttaatgagagcatttataaaaggtctattttaagcatatttaaaagacaatattaaggttttgagttctcgagtttggttgttttataggattgctgtagtcataagagtgattcaagaatacactcaacatattctccttttggaaaagatttcagagcttgtagtgccaccatgacatctctgatgtctcctgctttgcctgtgacactgacccctccctgtcattggtgagcagtgtaactttcacttatactcagattgccaaacttttgatgaggaaagtaaattccttttttttacagagaagaatttacagcactggagtttactactccttagtctgttgcttggtcagagaattcactgagtttctgcacagagatccctatggaaactgaacaaatacactatttgaaaggagacaggttattggtttttctcattaaacccactgctggattttcgttagttctaatgcattttctttcaagatgagacatataggccagttcttattttcatgatttgaataaactaaatatgttgagtcgtgtgtgcctgtacacatcgcctaagaagcaaaaataatccttctacttttgcaatacaattacccctgaaaattacgccagaaaaaccatgactgatgcaaatggggaatgctacccccgtttaaaaagaccaagttattaaataaagtgggaacggtgaaagtgattataggctaatctgattggttttatgcttgagtcacccccaaccttttaaatcataattgtgtatgaaagtaatctaaataaagcatgaaagatatcacagacctcaaacactttagaccctaaaaagctttatgtttcattggctattatgagatttcaaagagttcttttaaagcaaagatgttagtaaaacttaaattatttcaccttcttgaacttgcattgtagaggaagacaactttcactcttattcttcctctacttctcaccactaaagttactaaaaacgatttagactccaggtggtttgtgaggcaggagaatagggtccggaggcagggaacctaaggctgattcacctgacgtcctagaactaaatagaaaggaaaaccccaactttccaggccttagtaacagaaggaccacagcgtactccctttgcaaacttccttgttttctgagtggtgatggaaaattgaaagtacctctgattggttgcagaaagtactgtaaaatgttgattgcgggccaccacttcatttacatgaggtgaacaccaagtggccaatcggaaacctctagggaggtatttggacctgagaagattccgtactgttcccttgagctgctgctcgcgcactcccacagtgtggagtgtactttcattttcagtaaatctctgctttcgttacttcattctttcctcgctttggtgtggattttgtccaattctttgttcaagacgccaagaacctggacaacttgcagtcaagatcctctaccactaacactttgtatatttcaagaaagcctgacttatgcatgtatctattatttttaataattcaaaatctgtgcctcagtcttccttctgggtctcaaatgggcttctttttcaaacagaaagtactgatagacatttatttttctgtgaaaatttaaagagaatagtgataaacaggagtaccatttattattaagattgtgagtaacattatatatatcaatataacatttccttctccagaactttcgttatgtttggaaaatctgtttagaatgtaacagtagtcttcttttctcctaggtggctgtacttttgatgatggtccaggggcctgtgattaccaccaggatctgtatgatgactttgaatgggtgcatgttagtgctcaagagcctcattatctaccacccgagatgccccaaggtgagagtcactctgtttagtcagtgttgggggaatagttttgcagtatctatgattttcttatttaaagtgtaacaacaataatttaatggttataataagctaaattattgtgctactggatcacttctaagagccttattctttgcctttcccttaataactttctgtaattctgtattccttgttgtctttgaaaaaaaaaagataagtattagtgtttttttctatttaataaaaacccaagtgacaaaccaaaaatcaaaaaataaaagaaaaaacagaataaacaaaaaaaaatcctttccaaaaaattctcaaatgtgggatcagctcttttcgtagttattcaattaaattgtatatgttggatccaatcagactgaagggaaagaattttattacattgtaaggagagaggttgtgtctttctcccagtggtcatgagcatgccagtgactctgaggggaggcagtgtggagacaaaagtatcaaatggagatcttttatgtgggaattatagagaaatagggccagatctgttcttttgttgttgttgttgttttttgatatggagtctcactctgtcacccaggctggaatgcagtggcctgatctctgctcactgcgatctctgcctcccaggttcaagtgattcccctgccttagcctcctgagtagctgggactacaggcgtgcactgccacgcccagctaatttttgtatttttagtggaggcggggtttcactgtgttggtcaggctggtctcgaactcctgacctcgtgatccgcccgcctcggcctcccaaactgctgggattacaagcgtgagccaccgcgcccagcatcttttcgttttttaccttactttgttatatcctttgattttgggttttgggagataatataatttataattgtttaaaacagtgtgcattatgtttcatcttaggaaaaacacattaacataggatgtcaatatttacataccatttcatacaatattggactaatagttgtgctttcaattctgcatattaatctggagcaaattccaagttctgtgcgtatatgcttagcaataacattaaattgtgacattaaaatgtaaacaggaatttaaaaatacaacatgaaagagaacaaactcttttccttccaatatttagaaagaaacaaaaatagtacataattatatattatatatagttatgtatatataatatattatcattatgctattataatatataatataattaatgtgctgattgcttagtactaataatttaggtttcaaagtatatttagtatttttattatgattaaaaatggtttagaattaatttttctacaaaaagagtaagtccttcttgagtgtgaattttagatatgacaattttagacatagccattagaaatgaaaatgttaattctgcttattgaagagagaaaattctatcagcagcatccctgaacttgctgatcaatgtgatttaaaaaaaaaagtgaaaacatcaacaataaacaatttatcacaagcacacaaagtaaataaaacctaaaagttacatttctaaatgtaatttttagtttgtaaatgaatatggtaaatatttccttgaaaaattttgtgttggttcccccgtgatgtgtacttttataatagaatgaattaaatttgctttttactctgaattgtcactctccgtgattgagtaggaaatggttatttttgaggctgaactgagccataatttcctttgcagagggaaaactggaactgtgtggttgacactctttgtttcttatatttgacccctactttgtcagcagactcatttaattttgtgcgtagatttgtattttttctttcaaaggtatgtaaccttattttcctggtgcattttaattaaactactgtaatttttcacctgaattttctctgtggtatatttagactaaacttttcatataaaattaaaggatgtgggtgggctgggatgcacacattttgaatgtttatcatcatagaataataagaaagatgttgatttatggaaatgttaccattgctaattaccattgatggtgggtaatgaatagttgaagaattactgctcagatgaccttgttggctcacctttgatgaacagcttaatcggtggttacagtacaggatgatatgcacagaaaatgaaagcatttgaaattcagccatatcttccaattaataggacattaagtaattaatcatgcagaggagggaaaaaggtcacggccactttgccgaatgaaacagtgtttagtcttcagagaggtgagagaaagcactcatgtatgttattcttttagtcatctctttttataatagatactatttttttcattttccttctgatattcctttaaagtgctgactgaatattccttgctcataaattggtgtaaaggagacatttagatttttcatgctaaaatgttatgatctttttattgtcacataaattagcaagcatgcttattttctttatgtactttaaaaacacaaacaaaaacaaaacaaacaaaaaaccccaaatgtttgggaactctataaaagctggctctccaaacctaacttgttattgaactgtgtgatacttggtgctattaactggcttctgtttattaactttttggactgaaagccaagagtgagagaaaaaaggatgaataaatagattagaatgaaagaagactgaagatagatagtagagaataataaaaaaaattgtttctattcatgaggagatacagtaccatcaatcattgcttaaaatgttctgtagcagttcctacttactacttactacacagttccacatactagtttggtcagattacaatgatgatgactgaaaggtctgccaaatagaataaaaaatagcatgcagaagaatgagtacttcataagacagttctagtgtccccaaatcatatgaaattatgaacacctacttaactcagtcatcaaagaaatgcatatttaaaacacagtgagaaactactgtacaatcagtggaaaaatgaaaattttaattccaagtgttggtaagaatgtagaataagtaaaaccctctaatactactgttggagcataaatctgtacaaccttgtgaccagcaaatccattcttgggtataagcccagcaggactgagtatgcatgttcaccaaaagacatgtgcaagaatgttgatagcatcagcattcataatagttccaagctaaaaacaacccaaatgtctgtcagcagtgcaatgtataaataaatggtggcatattcataaagtgaaatattgtactgcaaataaatgaaagaaccattgctttatacaataacatgaatgaatttcgcaaacacaatcttaagggagagaaaccagatgcaagagagtatgtattatatacatttatataaattatgtaagtttcagaaacaggcaaaactaatcaatgatattagaaatcagcatattatttacttgaaggagggtttgggtaatgatggttagtgcttgtcaggtggcatgaaggagtcttccagatgctggtgatgatattctatttcttaatctggatggcgttttacagtttgaggtgtgctgaaatctgtaaaaagtcattgagctgtgtgcaatgatgagttgtgtacttttctttatgtatctgatatgtcaatgtaaattgaaaaaaataaaaaccaatgcacacaaggctgggaaactaaaataataaataaaatgtcatggattagaacaaaagatataaaatagatatcctcaaatgggtccaaacttctagttttcttaccatactggattctctcctccctactaaataaatactgtgttcgctgatatctttgtgtgggccttgtattgttcttttccctctgctgaaatatttctttgtctgcttatccattcgttaatctcttacccatttttactgtgtcttctcacgttctacctgctttgagaagattttcctgactggcttgaaactctgtttcttctatcctcatatcagaagatgcggcccactgtactatgtactacttaaattgtagctatttttatagtatatttcttatatgtccttctgtccattagactataaggtccttatgaacagccgggcgtggtggctcacgcctgtaatcccagcactttggaagaccgaggcgggcggatcacgaggttaggagttcgagaccagcctgagcaacatggtgaaaccccgtctctactaaaaatagaaaaattagtcaggcatggtggcagctgcctgtaatcccagctactcaggaggctgaggaaggagaattgcttgaactgggaggcggaggttgcagtgagccgagatcaggccactgcactgcagcctgggtaacagagtgagactctgtcttaaaaaaaaaaaaaaaaaaaagtccttatgaacatagaccatatttttttgtgttttatttctcaaaaaaaattatttttcttagacaaaaatgtcaacttctgtaatgtaagttttaaaatatttttgtcaagaattaaacaagatgtttttcctcttgttagaaaattaattgaattcaaaaataccccatttaccaaacattatattgagttgagatttttatgtaattagacccttacataattattaagatttgaccttagtctttataaatattacctatctatattggatacacttaaatgttgttaattctatcaaaaaagtgttctcttttcatatttctttctctctttttgtttttgacttttgcttgtcaaattccgatcttctgtccctcaaaagtctattgtatatatattttcagaacccatagagaataagagctgttgcatagaactagaaatcattctttgatctcaaagacatgtgtgttcttgacattgtttgtcaatttttttatgcttatgacctcatgaaataaatttatttgaccattttactatatgttctctcctagatctgagagtagggattgtgactgacatctcaatacatttatctttgactgtaattataactgctttttatttttaacaggtttttgcaaaatagctaattgaattttagtttagagtctctagagaacttatttgatagtatttaaaattatgactgaattgtatcccaccttcagtctagtgttttcactgataataatgaaaataactgtacagagttctttatttaaaatgcacacactgtatatatagtaaaaaatgaaagccctttgttgttaaattactctgaagattgaagtaaggaaccactcctcctcccttataaaacttagtgaggtctgattcagtagtttaaggccatatgtctctaagtgtttttctgaggagccaccttgatggagccaggtggtatacagaaaggggtaggggtgagaatgtaggggattataaaacagataattccaggaccatttttcaattatttatttggagagatttggtgtgtttttttattcagtggggagcatgcatgggtcacatgattttgtacctggctttcttctgatactgtgatgaagtgaaaattaaataagacatgggtgtccataatttgatgcatacaataaaagttataggtaacatgatttcagctaagtttcctaagtaatgatatgagtctcttagttttataagagaagatttagtaataatttatttaatttagtaataatttattaaaataatattatatatgccatggaacacattttaatacatctgagaaaaaatttcaaggaagttatgttgacttaggctttctttctctctgggaacagtgatcagttactaaaagtagtggatcactttgactaatattttcatccccctattatagatgattaataaaaaagcatagttttttacaaagccataactgtcaaaaatctcacacagctgaattaacagaattatttgacagtgtatcttccagagacaaaacatggcagagattggtagaataaagttctgtgcatgtagtattggcaatgaatattagcttgcaatattatcgctagttttgtattacgagattgagaaaatcaggccaaaatgttggtttactttctttttgtcatctacttagcattgtctgttaacacaaccaaagagagtgtgtgtgaacatgtgcagttgtcctaaggggaactgagagatttggtggtaatggggagaggaagggcttaacatgaggccattaacgtagatgggaaaacctcaaaaagtactggatataggtgttagattctaaggagcgtgaaaacttcagatgtttaaagctggaaggttatgcgtcattcaatgattttcagatttttttttaagtaatagaattcttttttaaaaaaataatattttctatcactttaatatttaaaatcaatgacaaggaatgaatggtcctggaacttatctgttttataatcccctacattctcaccatctacccctttctctataccaccctggctccatcaagatggcttctctgaaaaacacgtagagacatatggctccaaagggtagtttgaaaacaatgatgttgcagactcaagcacttttagaaaagcatctctgagatgaaagtacttactactattagctaccacttactggtcacttactgagttttactataccagggacatgacatgtatcttctaatcttcacaagagccttataaaattggtgatatttcggagataagtggagtgaatatcttaacagcatatctaccagagacaaaacatggcagagagtgatagaataattgtcacccagggacagaattggaacttaaatctgtctgtctaatataaaagttactcttgttccagtaccaccgtgcttcatcactgcagttgagttgacaaatttccttgacttgggcatgggcatttatttaaatccactatataatgagctatataatttatttgatttaatccagaatgatcttctactacttcatttaaaatacttctttccacaatttgaaagctttaaatgactgtttcttaccctttgtgggaaatggaatctgagactcactgttgtttggaattgctgccaagcttcaggattttctctatgatattctcatcccttggggagacgctttgcccttcctttgatttatgtgtatgttatttttagttatttgataaacacttgctgcgtgtctgtttaagcaaacctttagaaacacatatgttatctgctgtctcattagagcatgtatggtaaaagaaaaaatcatggacgaaaggaatcagactaaagtctagggtttgaaaataattttaagtctttgtttgcagtgaggtattttaggatgagaattatgggcttatttcaatgtgctcttccaaaccatgttatcatctgtctattgatgcttttgccctctgcacagagaagatagtttgccacatttgagttgcttattaaaaacagtgggagttggaagcagtgcaaggtgagagagtgaaaggctgtaatggactacttgaagggtaagccacttaatgaaggctggtttttaatgtaaggactgttaccctcgcagacataaatgcaacatgaaaaatgtctaaattacagtggacagaaatggcatgctgagactggaattttttcctgatatttcaggtacataatgcatctaagttagatatgtcctaatatatttcaggggaaaagaatagcctagtattaaaaaaaaggaaataaaaatgaatataggtgtcagtgctagagaacttccaacctcctagatgaattaagataggaacacacagcaatttcaaagactatatagtcacctttaacatataccttaaaatcaatacatagtccaaagactcaaaatttcttttccctggtaggagtgtgaccgaaaatacagttatgaccttatacttctcctctccaaaaataaacttgactcaagataggtaggtactatctcagtttaaaagcttattatctttcaaacacaagaagaatgccagggaaatacatacacacacacacacacacacaacaaaaaaaacaaaaaaaaacaaaaaaaaaccgagcaaacaagaaaaggtaggtaactaggaattattaaaaatatatatgatattaattatctcttataattaatgtgaaaaatatggagttatgattatatattagattatcattacatataaaagatgctttaaaatcttggaagaatgttagttttccaacctagtttctgccaagagtggtatgttgtaaagacctctactccctcaccaaagaggaaattattggctgagatgtatttttcaatgaaaagtgaacattttctaaatttagagcatatgacaacttagaaatgctcacagcatcatgaagtctccacctagccatgctgattaaaaagacgctggcttgctttttctaggtttatgagaataaaattaaataggacagttttacaaacttcatcaagctggttatgtatttctgtatgttcctcccacctcagttatttaagagttggagattaaataggaaagtagggtggcaattttgactattcaaaagttatgttttgagtgtgtaatttttatccatgttaggtcagacttactggatacttaaaaaataattctctgactccttctgtctgatcccaagcatttaaaatatgtcatttcacttaattctcccaaaatgcctttggaatatgtatttacatcattctgtaggtgaaggaactgaagtcaggtgaacctaagtaaattatcaaaggttttatgtcttgggaaaggcaaggctaggaatccaggtatatagagatataggataaggatttaacctttgaactttataaaacaagtatatgtagagatctttctttagagactgcagcaaaaagcttcagggctgacttggaggtgtggcagaagttgtatctcttatgccttttccagtgcaagtaatgggaagcacaactacaaatgtgtttaaaccataaggaaggctactttcgcataacaaaaggtccagagttggctcattcagtggctcagtgatttcatcaataattcagattttttcttatgtctttgcctctccattcagtaggtcatctttttacctcaggctatctctctttaaaggtctaaaatctatggctattccaggtacaaaattcagacacaacagtatcctgaagaaaaagaggttcttagttgtctcctccttatgtcttataagtatcaataaataaacacaaaaaactttcctgggatactctttgatatagatatgttagcatagatctgtaagtagagtttcaaagctgtgggatttagaagaatgcacaaataaagcatttattaaaacagcattgtattctctaatgcaagcttgtctaacctgtgggccacatgctgcccaggatagctttgcatatggcccaacacaaatttgtaaactttcttcaaagattatgagattttttgcttttttttttttgtaagctcatcagctgtcgttagtgttagtgtattcttcttcttccagggtggcccaggcaagccaaaagattggatgcccctgctctaatgcgttattcagcctagcatcaggtttcccttaatttcatgcatttactgcatatgttacatatgcagtatcttcctacccctagtaagcttaccttatctttctaacctgccattgttactcactagaatttttcattgtctcttgttttccttatgatttttatgatgtggaataaataagggaacatactttatttaaaaaaacctccaaaacgaagaaagagtcaagtgttatacactgtgtatgtgagtgtatgctaaagatagattaatttattattaggggaaccagcaggatagtaagactggttcaaaagattataggaataagggaaacatttataatcagtgaaagaaagaatggtggaataagattcctaaattttatactaaatgtccaataagacaatcaaagtgaaaccatgaggctatctttactaacagacaaatcattttcctctgtactagacaaaatttgtttgcattatcataatatgagtatcatttgtgttgctataaatgttctacaagttaagtcttttctcacagagttgtaaaatatcttaatcagtggtaattagtgactcagatgaagcgacatacttttaaataattagcgaatcctttggtgaaggatatacagtcattcttgtgctgggtcccaagttttgaacattttttcttaaaacttcccccttaggatcgtaaatattatccaaggatgattcttgtttaaaacaacaaaaaagtggtatccttttgtttttgtctgatttatttatttatttatttagacagagtctcgctgtgtcacccaggctggagtgcagtggtgcgatctcggctcactgcaaccttcgcctcctgggttcaaccgattctcctgcctcagccacctgagtagctgggattacaggcatgcaccaccatgcccagctaatttttgtatttttagtagagatggagtttcaccatgttggccaggctggtctcaaactcctgatcttatgtgatctgcctgccttggcctcccaaagtgctgggattacaggcatgagccactgcacccagcccgtttcctttagataggtgcagcaagaagtgtttattgacatgagccttgtagtaggagtgaaatatccagtgtcacgcaatattaaacaattagtaagagtggaaaattaacatctatttgaagatttcattagaaatctagaattgtgttttcagtagcctttattacttcagagtattttaaaaaacaaaacttggtttcttcttcttttcagaagcttaggaaccaactcaaaataaccatctccattaggagtatttcacttgaagttcttataaatgtgggtgaattccttcctcttttatgtcacccaaatgagctgagcttccttgcttgccagggattaactatttcctctcaggccgggaccctataaactcagactaggtaacagaccctgttactgggagggctctataggtatcgattgtttccacatatgaaatacacagcctttgtctctttggtgagcttatcatatgtgttttagtaaaaaagttcttcttaatcaaacaatttgtacacttgatttgtcaaactatattctggttaaagaaaaggccgattcttagttatttatccagttatctgccattgaaagtaaagaaaagtagaaaaaaaatctattactgaatatcttagatgtcagaagcacatatcaattaaagaacctttattaagtcaaggattaaaattaaatcaagataaataaaaagctttattattatatataccaatcaaaaaaacagaacattaaaagtatactgaaaatctcccaaacaaataatgccaaattgattcactgcatgagttcctttaagttatatttaactaattatttatctcttgaatttggggattatagtttatttcatgaagtcatcaatcctagaaactctggcttagtaacctggtatagtctggctgatgtctaggtgatatcagctctgaagcttgtacccttgaggctggtccttgaagacataacagttagatgtacctgatctttgactttctattgaggccagtatttgaagacttaatctgtggagcctatagttaatagcagagccttcaggcaagcatgggaggaatgcagaaaccacctgctgaatgactgaatgcttgtgattaatttattatagtaatcaaccgtatcacactagaaaagagaaaaattctccatcagggtataagacttactatttaataagtatttgttaacagctcctctgaaagtaagaatatatggacatgactgtattaacagcttgccatgttcttcccataaattgaattattttggacacattttatattacctgaaaaaaattaatgcacagaaagttgaactaatctgatttgaagctctttttcatgcaagccttataatggtgttgagctaattaaaaaatatggaacataccaaacaaatttaattatttttattgttcctaatcttacaaggcaaggaagtgaatccctgcggttgtccaaagacctataggaaatcacaaaggcagattagaagaaaagacctcttgaaatttttattttttctgaatttgttgttttatcatgcaaggaagaatcagaagtgttatcacaggagattggtcacttgattaagacaggtgcctaaaaataaggaataataccagtattttaaaattattaatattaatatttataatattaattatattaatatagtaattttgatatttaaaaataaaatagaaggtaacacaatgataaggaaactcagctcttccaagaaataaagttgtatttgtttttaatcatcaaaaccataataaaataaacttaatatgtataatactatcctggagagatacccaatcattcctcagattaaacagaaattaggaataatttttgtaacctctttttaagaggagactgaaaatactaagatcaatttgttattttaacagagataaaacctaattccagtctggcattaatataatatttgacagcaaaagctttaaaaaaaaaataaaaattttttctggtcaccaaataatttatttcacgattgccttgtattcaatgtatttctttaaattcattatgttctgcacacattccatttgtagttactctaaacttttcaaaatatctgtactattctgatgttttactaactgttgtatttgaatgtaactcacaacaaactctttccactggtggttttatttacatcaagcttgtccaacccatggcccaccagccacatgtggcctaggatagctttgaatgtggcctaacaccagtatggcctagggaagccaaaagattggacacccctgatttacatattatattgagtttttgagtcataagtaaaaatactttctcaggaaaaaaaaaatagaaatattgtccaaaaatctttgtattgcgagatatctctattaagttatatgttgagaaatatctccattaaatttggtttttaaaccaagaaaagttttctattgataaaaatatggacaaggccaacattttgtggactatcgtgcgtgtggaacatatctatgagaagtcccccttcaaccagttgtcaaagtgagtcttgaatgagaaggaatatttattaggaagggaaaagttaatttgaaattgtatttttgatgtaattgttggtaatgagcaagcctaaaaggataggaatttatttcctaaagtagcagctaaagtaacaaaaaaattatccttctctgaaaagtttaagaaataaattcaataatagctgtataaagcatttgggtatttaatttttctcatgtttctagtatattgctttactttatatgggactaagaaataatttaacttaatgttttatagaaaataaaaatgtgtttaaactgtcaaaatattttttctgaatgtaatctactaatgattttgacttattacttttgtggctataatgatagttaaaacaatgttaaagatatgctattgttcataaaaccacactgttcttgacaatagaattaagaaattgatacttaagaataaggtgaaacaataccaccgttcagtgttgtgcagtttagcactgtgtttggcacatagacctatgataaataactgttttatgaatagctcaaaagcttaaaaatagaaacatgattttctcaactttcttctggaacacataagtatgttggaactcaaattatttttgaatgaatacataaatggaatgataaatttacacaaaggaaaaaggggaatattttagaaaatgatttgaatttaactgttgttaatgcactatactattgcaaaatggccttttgaagctttttaacgtagatgaatgaataggatggatctggtcaagaggattgtctgagtgggtttaattccagccccgtataacactataataatattctactgatggtgtttatgtttttttttctgcatgttacatgaaatctttggaagtttagatctttgccccagtattggaagattatatttttcatgttacgtcttatagttaaactttgctattaaggatgctattgtgacaagaacatgttgctttatgtaataagcactgatttcgattttttaaactggattattcaggtattttcattgccactggaaccaagaaacagactcttcttagcttagcagtggtgactatttcttctgttctctttgactcaaaattgaagtcaatgaagaaaagccagtgggaagagctgattgttgccatatgtcacattccttatgataaagtctaagtttctccctagtaataaaatttatataagccctttaaaaaataggatgacatttatgttagtttcttattttcgcaggctgagcagttcttttactgaaccagtagcagtggtacaaaagttgttttgaaatttcaaatgctctacatctatgtttaggaagtggacacctataggtcccaagaaatcattagagtggaagaaataaagagaaatggatggtcaataaaaacaatttataatttttggctgggtgtggtggctaacacctgtaattccagcactttgggaggctgaggctggaggatcacttgaggctaggagttcgagaccagcctggccaacatagtaaaaccccgtctctactaaaaatacaaacaaaaccaaaaacaacaaacaaacaaacaaaaaattagccaggcatggtggtgcgtgcctgtaatcccagctacttgggaggctgaggcaggagtatctcttgaacccgggaggcagagattgcagttagccgagatcacaccactgcactccagcctgggtgacagagtgagactctattaaaaaaaaaaaaaaaaagaattttcatataggttttctttatgctgcttttaaatatttattgtccatttttaaatggacacatgattacatatagttgaaaagatagtattctataatagaagtcatagttctttgtgctcaattttcctagtatttttacacacagaatctccaaactcagcatatcatataaaccattttggtactagcaccattataatactttcaacattattgaaattgatttttttcctttttttttttttttttttttgagatagggtattgctctgttgcccaggcttgagtgcagtgtcacagtcatggcagtcctcccacctcagccttcctagcaagtgggactacaggtgtgtgccaccacacctggctaattcttgtatttttttgtagagatggggttttgccatgttgcccaagctggtctcaaactcctgggctcaagtgatccacctcagccttccaaagttctgggattacaggcatgagccaccatgcctggcctgaaattaatttctgttaaatctgaaagagactctatagattatctctagtctaaacttccgttttacaaataaagaatagtgtagaaataggcaaactgacacaggaacctgagtaacctgaatttaaatctaggttttattgcttgagatttggtcatgacatacaacctttcttagcttccattttcccatcagtaaattaggaataataacatttctctctctctctgtaaatgttgttgtaccagtgaaatgaaatacagagtgcagtatctggtagtatctgggatgtagctgatggtgaatgaataatatttgcctccttccctctggcccaaggtgacacggccggttagtaatctcattaatctataagaaattggtttgaatttctttcacttactttttttttaaaagcaaggaataaattgcactttctcatcacaatatttcagtagctcattaggaattattttatatccaattctgaaaatcacctttgttatataattgctcactgagtacagttgctttgcactctgacgcataatgatatctagaaatgatttttataacaaagatagaataatgaggtatggaaatagtttgggaaaaggtttattatttctcaagtcttaagactgtttttatgtagttattccatgtgggttattgaattgctttgtggtcattctaattaaaaaattttctaatgaaatacacccttttactttgaattttacttaatgttgacagcagctgcagtctataatgtcataaggccaaggaagaagttatgcaacaacatttaaagctgagacactggaaaaattgttaaaagtatctcacactgcaaaaacacaagcaagcaccagcaaatatctagatttgaaaaaaaatgggtttaaaactgtctgatagagtttattgtcatatatttaaaaatctggatattctgttgcacaaacagattttggttttatggcttacagtagaacttgtaagatacttacttggattctacatatttgagtaattttttaacctgttttcagatgtttgggctgtgcccagattgttagctacgaattcttgttctaaaatgagaaatctgataggttggctgtcttacctgtgccttggttacgtctgttgaagaatgagagaaggataaattctctctgctctttgtaggtcccttttacatactatgataattaatgtattttcagttactttgtatgtcaaatgcagattcctttaaacctgcagctccatggatgtgtttacggggtttataaaccctttaaaagtgtaatattgcatacacacacacacacacacacacgtgtgtgtgtgtgtatgtctgtgtgtaggaaggtgtgtgattttccaagaatgtattagacacagaatatcagaataatcacgcagaatagtagcagaattctatagagtacaacattgaacaggtctctaaggcacagcccttggggaaggttgcgtttataaggggaaacaaaactcccactttgctcatctccaagtctggtatcttgtgctgatgcaatcaaagttgatacttttttctacagagtctcctttgcacccttttaattttattttcatcctttcaaggagagttagctatatccagaatttaaaggatgtaaaattctttattctcaaagaattattgtgtgaatttttttctctcctgaggctaatatctgtaggttttttctgttattgatgaacacatcttttttatgtcccttttgctatactattgagatgaaagcccgtttgctagggtttacatccaggctgagcagggtttggaaaatccccttcatcctttttcttccatatacttaacctattgtccatgggaatgcttagataaattactttgagcattgtgtttttcatttcttgcaacttaatgttgattattacaattaaagacataagtaaaaacaaaccaacaagcacacaaatattattaaacaacaaaatattagatagcaaatattatgaaataacaaaataaacagacagtttgccatccattcctaaagtgaatgccctggaaggtcaaggctttttccctctgtctagccaactagtgttagaaaggaacatgtgacttaccaaatgtttcataagagtctgagaatatctacagctgtaaaggatttgctgtttttggaaatataaaaaattgttccttttcttcaataccttatgaagtaaaagaaagcaactgaggcatttctgccaaagaacttcttatcttggaagactgaggctctggactctagcacttacaccacatgacatggacagattgtcctctctttcttaaaggtaaaatcaagactttcctatttgtccttcttttcccagaaagtagttgtaagaaccaaaataatacatgattgtgaacatactttgaaaacagttgaagtatgtttttataatctcacgaagtaacaagtgtattgtgttggtaatgtaaatggattgatacttggatctttaattattccatgtcattttactagtcaatatctcaaagaatgagactcaatcacatggttcatggcagtgcatcatatagcatttattcgattcatggtattttatcccatgactctaggtagtaatggcagagtacagagatagagagagtagaaaggaagaaccagtaaactggagtatgttcaaataaagtagctgaacttggagtcaccagtttccaaaaagaacagggagtagaacatttagtcagaaactagacagactagtagaaagatatcaggaagatgaggcaagtggcaaataatcaggtactatattatattctttctttcttaatagtgccttgaatagtactttactgtgatagacattcaataattaaaatagcttcttaaagtttaatctctaaggtcattttaacaatagcaagtaactcattactttcctctgttattttcaatcttacttgaactttgcatagggtaagaattatattggagtggagataaaactagaagatatttatgcataggtgaaaacagcatttataagaagaaaatagatgaaagcaggaagtgacaaaattctgctctgtaaaatttctccaaaagtgagatacgtatatattttcagttatatggcatatttcacatagtattctttggacttctttgaacgattatgcatatacattagcagtaattattttagaatctaatttttatagtcagattcctgaaaggtatttttctcaagacttttctttatttgtattttcagtggaaatttttttcatgcttattttcttattttaacatttgtacatgtatatgaatgaaacaaaaatggttagaaaacatggaaattatacataagtctcataaccaagagaaaatcaccatcaatcttttgatgtcattttttgttacctctaagtctatgtttgtgtgcattgttgtttgtatgtacatctctgtgtgtgtctgtgtatatttacttatgaaatcatgaccagatagcatgtacattttttgttttgctttcaaaattaatgctgcatcaaacatccgaaaattctgttatttataattgttatctttgggaagattggttcaataggaactactcagttttgtccagaagcaaggcctaacttatgttttacttaattatatttgttttctagttcataaatgtaataatttcttaattacatatagagatgaaagtaacttatggtttatatttattgaaatataactttcaccttaatatttgtggttaaattcaatctatttttgtgaagatttgtgaaacacagtctaaaaagcaaaccatgatcacagattacttctgaaatataattcttgactatattggagttaagcagagcaaagaaacatgtgctctttttcaacagtaagaaagaaagaattctaatgtgtttaaaattcagcctaatttatatgcttgtaacagtttggaagttgattaaagtctgtagagtaagtgaaaattacatgtagttctcattttagttgaccttccatgttaattaggacattttttttttccatttattttgtagttaagaacattttctttatctagtaaactttgattctgggttttttttcttttttttttgttggttgcttcttgctttaatgaagttgatcactttcatatcccttttaacttttctcaagatgctgaatatgattttgaaatacaaatcaaagtactatgatgaagaaaatttaggcagttccagttgtctattacttacaagtcagtcatatattcatttaacaaatatatatttaatggtacatgatatggtttggctctgtgtccccaccaaaatctcatcttgtagctcccataattttcatgtgttgtgggaggggcctggtgggagatgactgaatcaagggagtaggtctttcccatgctattctcgtgttagtgaatgggtcttacgagatctgatggttttaaaaaagagagagtttccctgcataagttctctttgcctgctgccatccatgtaagatgtgatttgctcctccttgccttccaccatgattgtgaggcctccccagctacatggaactgtaagtccattaaaccctttttcctgcataaattacccaacgtcaggtacgttacatctttatcagcagtgtgaaaatggactaatacagtaaattggtaccaggagtgaggtgctgtgaaaagatacccaaaaatatggaaatgatttggaactgggtaacaggcagaggttagaacagtttagagggatcagaagaagacaggaaaatatgggaaagtgtggaactccctagagacctgttgacttgggctttgacatttggctttgaccaaaatgctgataatgatatcgacaatgaaatccagactgaagtggtctcagatggagatgaggaacttgttgggaaccggagcaaaggtgactcttgttacgtattagcaaaagattggtggcattatgcccctgccctagagatttgtggaagtttgaacttgagagaggtgatttaggttatctggtgaaagaaatttctgagcagcaaagcattcaagagtgacttgggtgctgttaaaggtgttcagttttaaaagggaaacatagcataaaagtctggaaaatttgcagcctgacaatgtgatagaaaagaaaatctcattttctgagtagaaattcaagcctgctgcagaaatttgcataagtaatgaggagccgaatgttaatcaccaagacaatggggaaaatgtctcaggatatgttagatgtcttcacaacagcccctcccatcacaggctcagagggctaggagaaaaagatggttttgtgagtcggacccaaggcttccctgctctgtgcagcctagggacctggtaccctgtgtttcagtcatgccagccatggctgaaaggtagctctggctgttgccttacagggtggaaaccccaaaccttggcatcttccacatggtgttgagcctgcaggtacatgaaagtcaagagttaaagtttgggaacctccagttagatttcagaggctgtatggaaatgcctggatatccaggaagaagtttgctgaaggggtggggccctcatggagaacttctgctagggaagtgtggaagggaaatgtggggttgatgcccccacaatgagtaccttactggggcaccacctagtggagcagtgagaagagggccactgtccttcagacaccagaatagtagatccactgacagcttgcattgtgtgcctggaaaagccacagacactcaatgccaacccatgaaagcagacaggagaggggctatagcatgtaaagccacagaggtggaactgcccaagaccatgggaacccatctcttgcatcaacatgaactggatgtgagacatggattcaaaggagctcattttggaatttaagatttgactgccctgctggattttggactttcatgggtcctgtagtccctttgttttggccaatttctcctatttggaagggctgtatttacccaatgcctgtactcccattgtatctggaaagtaactaacttgcttttgattttacaggctcacagatggaaggaactttccttgtctcagatgagactttggactgtggacttttgagttaatgctgaaatgagctgagactttgggggactatttgggaagcatggttggcttggaatatgaagttatgagatttcggaggggccggggatggaatgttatgatctggctgtgtccccaccaaaatctcatcttgtagctcccataattcccatgtgttgtgggagggacccagtgggagatgattgaatcatagggcaggtctttcccatgctattctcgtgataatgaatgggtctcatgagatctgatgtttttttttttaaaaaggttgtttccctgcacaagctctctttgcctgctgccatccatgtaagacataacttgctcctccttgccttctgccattattatgaggcctccctagccacgtggaactgtatgtccattgaaccccttttcctgcataatttacccagcctcaggtatgtctttatcagcagcatgaaaacaaacttatacagtttgtgtgccaggtattcttccaggcacttgggctaaatccgtgaacaaaatagacaaaattctttgccccagagaagcttataccttgatggggaaaaggataataataataataataataataataataataataataataataatgcagtgtttctaagtaccatggagaaaattaaagacctaaaagatgtggaggagtatccatgcagttatctaggggaaaagcattccaggcatagggatcagcaagtggaaagtccttgaactaggagcatgcctggcatttgaggaagaataagatgaccaatttggtttaaagaaaagagtggaaggcattgttataggagataaagtcagagtagtaataggggactgattgtatatggctattatcagtacttcacaaagttctaaatggagtgacatgattttatcttgacagggtcatactgagtgcgggatgtggagagtagacattgggatgggacaagggtggaatcagggaaactagctattaggcagttgtgataatccaagtcagagaagattataacttggggccaggatataatcagagatggttattaaatattagggtaaattgaatttgctgacggattggatttctggtgtgagagaaagataggagtcatggatgagtgaatattgttttagcctgagcactgggaaggacacaatagtcatgagctgagatggggatgaatgtgagaggggcagatgtttgggaagaatgggagttaggttttagagatgttaagtttgaaatacttaatcgatatgcatgtctgattatcaggggagaggactatgctggggatacacactttggagtctttattgtatagatggtctttgaaaccatgagactggatgaaatcacaatggtataggtacgaatagagagcagaagagttgcaaggaccgacacatgcattactccagtgtttagagttcaaagatttagagaaatgtacaaaggaaactaagcagtagtggactgtgccatcagaggaatatgcactatattgagaaatatatcaataaattctgagaatgattcaggtgaacttagggtagaatgattaaacgtctgtttacctttctgtctttatccatgaaagaaggaaaataaataacaaacaaggtgtgagattaatattaaaatgtgtactggaaaggtactggaaaatcagaggatgggggctacatctgtatttctgaagcctttttaccctttcttgttttatgtagtaagaaatggaatacaattaattgtaacataagataaaatataatcaaatattaatagaaacaattttgttgctcaagagaatgataactactgctagtactgagactaaagggtattcatgggcaggcaaagatttgtgtcataaacagaaatttggagtgatcactaccacaatggtgaatgaaagatggagaagcctgcattctagaccactgtgcataggtgcatattgatcgcatagttacctttagcactttgtaatgttatctgttagtattagcataatgaaaaatcagaatactaggcctagaagaaaagataatttcaagcaacatcgaggcaatgttgtaagacagttatgaaacactggttctcgaagctggctgcattttagaaaaaccagacattctttataaaggattaatgccacacccccagaaacttctgtatatttggtttgagttaggactagtatttaaagtcccataggtgattttaatatacaactaatgataaacatcaatgtaatggaagccaaggcattgtgtgtgaggatgtgcgtgttttgtgtctaccatttgtagcactttgtgttgcaataggttatcctgattttgtttgtagattattgcatatgcatctgtgcctaattgatatctgtgtgctgcacatcaaaatgtgaactaacgcagctttgcaaagagtcaagtccaaggactaagccttgcaactttatttaaatagtatatagaaaaattctaaaaagaatatgtgaccactaggaataattctaattggttggttagcagttttagcacaatgtctttgataggcccttacatttgccacatagactttgtgcttttactgggaaatgctaactaaaaaaatacattggaatgtttccagtcctaggtcaccatttttttttttttttaaaattacctccctcattagttcccagcattacagtgtatggtacattcacatatacacacacatactcatgtatatcagagtactcagttctgttcatttcctcattccatttttcttttcaaaatttggcaggctatagtgaaaaaactcaggacactgacttaccagaaatgtgtttgtgatgtgctgaaaagttagacacttttctgagagccaggtaggggtcttctccatgtactatggagtagccatttataccagtcattcatgcctgtcagagtatcatgtgtgggcacttaaaatacaacataatgaaaatcaactctccttattatcattatctgtcctcagtaacctaaaatcaagtattaataggaaagaccaactacaggtatagaccttatttacccttaggtttctggcctgcttttcaactctttggaaattctctttgaggattaaatgaacaatgtatacaatgtgcctaatgtacctctgtcactttatctttggttttcctgatacattgaatgttggaataaactgaatcctgatttttgacttgattcttttgttcctgagtgttcttgtggtgaacatgattttaattaccacacccaaagcgttaaaaaaatcatttcctttctacagattctccctgaattctactttttcacttctaatttatttttatcaccatttcctggtattcttttgccatgcttttgaagtccattcctttgttatgctataggcaactgctagcagacctatttctgaaaaactctatttgacaatttaaaataaaagtcttatagtcagaacttggaaacagaacgagaagttggggctagagctaggggaatcactaagttgatgtgagagaaaaagcagtaactggaaaggaccaaaataatggacacatataggtcaactaggcaaatgtcatttcatgcagttgtgtgcctcggaggtcctaatctctaaccagtttttcttgtactaaaatgccattgaatttatagcttaagcagagtaattaaaaagctgagaaattggtgatgaagaatgaaatctggaatggcttctctctctctctctttttttttttttttgagacaaggtcttactctgtcaccagggctggggtgcagtggcacgatctcggatcactgcagcctcgacctcccaggtttaagcaatcttcctgcctccccttcccccagtagctggaactacaggtgtgcatcatggtgcctggctgcatttggccttgctttcttgagattattgcatttatttgtttttcagaaaagataaagatggtgattggttgggtgagttagtagttagggttctttcagtatcttagagttgactccacaaccacagttggaaggaaggaggctctttaaccaaagtatgaactactgttgaaatatgctgatgaagtgtgagaatgacagcagcagattgtaatggattttgaagtgttccaggttttaatagtaactaatagtagaactatagttcaaatctgtaatgacaacattgaaactgtagtcaaaatactaaatctagattgcattaaacctttttatgagaatacgtaaaattatcatatgctaacaagctatcaatctgagttagaaatgcttggcaataaaagtgttgtttcatttgattgatattgaagtagccgtttgttttatactaacttcacattatggtacagatagagtccaaactgatgaaacagatgtaactaataaaatgaatcgacagtataataattgtaaagggaaataatcgaagacaaagaaagtgttttttgagtttttttgctgattgggtggtgagagtggaagagcgtgggaaagcgtggtataattcatagacaaatcctagtatttctctgtattcagtttcatttcactgagttgtctgattgtaattgagttgttcatattgttctcttgaaatgttttgaggcaaatgaaatcttctaagaattcaagtatagtgaaacaatagccacaagacatggtaaacttattgctgatgttaacaaaggacaaaaagggaaaacatgatttgtatttagtagtgttggtgctattgcttggaaccaaatatttaaaattatttgcaaggcaaatagatttgactttaatgatgaattttggtaataaatcatgaagggaatcttttaatctttgaagtaataagctaagcgtgcttttttgtgagatgaattgactttaaaaatagtaataacaaaagtctaaaacatatttacaaatgatgatttttgataggacttttatataaaaatttgaactatcatgtgataatcctgaatttaaaacctaacagttttactggtagaaattttttatgagaaaagtaatgctcatttaagtagattttaaagtaaaaaaagctaagatgatatgatgaattatcttgatgttaaaaaggcactgcttcatgaataatattactatgaaaaaatatttgagaccctaaaggcctataaaggagaaatattttatttaggaaatgaaaaaatgtatatcaggggcaatagcttaggggaccctgagttctattccctattttactgtttattctgtagctgtgagcaactaatttaaccttccaaaatcttttcctcatttgagtaaggaatgactaatactttccagctacatcaataacagggatgccctggtggatgatgatgtttgtaatttagtacattaagctctgtgggtggaaggcaagtactacaatatgcacaagctattatcgtcgaaccactttttgttttaatacttattttaaaaatatttattttgattctgttatgtgcaagggaacaaatgatatgtcctttctgtaaactctaagcctctgaaatgcagctttcatttcttgctcattattgtatcctgtccattcaagctttgcttttaatcttctacatggtaaaaaattaacaaatgtttatttagaccataaatattttgaatggtttcaagttttgaatggtttcaaagtttgaatgtttttttttctcttacaagactgtctgctttagaagaaaggaacttctgtttgctactatcctcttacctcccatcattggaacaaagtgctcagttctggaatagatttcctcactagcatagctataaaatattcttcagaaacatggcatccacgtctttgtggcatatgccataagagcatttactaaaatatgagagaaaggttaaaaattaaatgaatttctaaagctttttaaaaaattgctaaactttcataatctattcagcttctcaatacatgtgagtttggaagacagtaatttctataaatttattaacatttaacctactaaatataattctttgaacatggaatacagctaaatttctttaaatattcttttgtatgtcaagaatttaagaataaagaatagtcagttttcacatgcagtattttgtttaccaggtagaagcctaacttaaactcctatttatcagaccaggatctgatatattttgaatgtcttataaaatatctatattgttcttgtaaaatgtctatctatattgttcttatatctgaggttttacctggggttccctgcctttaaacgttatttacatatggaatattttcatttttctcttcaaagttaaactgtactttggaaaagagctcactctctataatcattactgcacttctcaaaactgccaccttttcttcaggaatatagaagtgggaaatgattctgtaaaatttcaaggaaagagtggtgggacagtaatggggaaataacctctttcccttggtaaaatgtgtaatatatcttttaaaggcaggaaacttgacttgtgaagtgatggtagaatttaaactgcatgcaaagccaaggctctttaaaagaacgtgaattaagtcaactatgtagtttagctcttgggtgatttttttgttgttattgctgtgtgtgtgtttttttttttgtttgtttgttttttgttttgttttgtttttttaaatagagtgaagagttttattcttctatagcctctgaataatggaaagacttcctggtgcctgaattttaaagaccattattgtagtctataattgtattgtactttggaactagagagtactgtagaaacctagtccaaatgccttactttacagacatggaaacttagttgcagagaagtagcagtacttgcttggtgaagagcacgtagctacttggagttaaggtgacaattgtcatggctcacccctcactctaggttttgtggtcctaaagagttaaaggaaaataatttctgactcagatactcctcattccagttagtagcaatcttgagttagtagcatttattttgtgttaaaaataaattggaagtgagttgacaggaatgataaagtttcattgggggaaaattaggattattcaaaggaagctccaactagtcagaggaagcaaccagtaaaagcaggatcttggtcattggcctcgtcacagatttgtctgcactttgacgttttttttttttcttttttaacagaacagtttattgttaatacatctctccttttattggaattcctcttacatgaatggattttgttttgtttgtttaaatagagtaagtgttgatcatggctctatccctttcttttcatcttagttcctccttcagtttatattctctgctctctgtcaccctaaatttattcattaaatttagtctctgctttctgttgtccctgtgtgtgagcctttgcttttcatgtctatatttcagtgaaattgggacctgttaattttctgacacctgtagatttaaatccagtgacttacaaaacaaactcagcaattttggaatgagaggacatctgtgcattttgcattattttttattgtgaacatgggaaggttatgtatgcacattagagagtcaaatttcaaaaattaagtactggatttgcttcatttaattgctttataaaattgaactaacattgtaaatcattaaagtgagaatattttttcccgaaggctctctcaaactctcaagtaggacattactttgtaatttttatagtagttaatggtttccatttcagtattgctattatgtgctaagaaacctgtgtttgatgtagggacctagtattaatgaggcccaagttagtggtttgatttatatatgaaataatttagaaggagaaatgctctctatcaccatacttaatattatcttttattgtagtattggccttgtgccaacacttgattcggagattagtcaaaggtcagaggtgatcatacttgacggtttagattcttttggaagctaagaaagcaaactgtgccaggcccgccctgagaccacttaaatttaagtgagggccagggtattggtgtttttaaaagtgctgcaagttatgtcaggttggataatattggatacattaggttaagtcactgaatttgtcgatagttggctttgagccttctactactttgggcccaagtgggtattctaatggctggttttacatactccttggattctagaatcctgtgatattggaaatctctctttaagtaaatgctgacaaactggttagaattaaatggggagggtttgggatggagtcctggataattcagcgtcgccaattgtcagtgttggaaaaccagcatgcagaatatagtagaactgcatttaaattaaccatacatcaacagatatttattaagggcctaccatataccaggcatggggttagaaaagtcaacagagtagtagattattcttcgcttatggagtttacatccttaaagaaggtggcacatagagaccaaggtactataatatagtaggtccaacccagctagcttccctgcagtgctggggctgctgagcatcaaacgagaagtttgcttggtgttgggagcctgtttctatgaagatatctatcttctaacgctggagtcatcctctgaatccaaagaagctaatactgtgagaggtaggagggaagtaacatgatgaagggaatagcagatctgtgtttgcaatctgacttgcatgctcattaagtctaaaagcaggcaaactgtcaccatgattttaattcactctcttttatgtttcatgaacccacacagttggttttatatatgttcaatgcacacttgacatgcctccacatcctcattgtgtgttattaatactgtaaatatgtaaggcattgttgtcacagtctctgggatcatagacttgattgatttctcaactctgtatcccgaggtggataagttaccttaaacttaagagtttatttactcagccataaaaatggatactgtgatatccactttgtagtagtcttttgcatgtctgagatgtgtaacccctttagtccagtacttggtacaaatagatgcttagtaaatggagatgtttttgttagtataagaagagccacaatttttatttaatacttaaaattgagaaatagggaaattattaaaactttaacatacaacaacagaagagatgtgaaacatatttatgtacattctttcatttagagtttaaaggttttaattacatctgttgtattagttgaaactttcttgaataactacagtgtttttccgtaagtgatccaagttttctattttgctcttttccaaaagtatcatctaacacctgcattttagtacctaaggagctagttagagtggcatagtactcccaaaagtgtctaaggctcgcttcatttttgtgcttaccttgagcttctttgtgtgaccctttactgacaagttttcctaatggtaagggctagttcatcaggaatattctatggaaaggcttatctgtcttctactaaaatagttcattccctgtgactgatctgaacttagaggaaatctggctcagttgtcacctaatgtttgcagaaagattcagagattaataaaacatgagtctgtgttgcttgagactgtgtcacaagtattagatccatagcacttctgggagcatttaataagaatagtcaagaataccttagcatttggatatcaaacctgattaggttttaaaccagtcttatcaggttttccttgttactgatttaacttaaacattgcataagatcattggcttggaagccattcaactctccagccaggagaggtacctgttctctgtgttctaaaagtacaaagacaaggctgatattgataacaaattacgtaacaaactcataaatacagctcaaaatgctatcattagctgaagctatgcacaccatggctggtgggcatttacgattgaggaacttatagcatgttagtatgaatggtcacttgactagaaaaagtaataccacctccacttcatatcaattataaaagacttcagaaggcattttataatctaagtttttattctctggaagtatttttattttaccacttcatttcttttcagttaaatattacctcagcctttctttctcttatctctattcaaatgatatcaaatctcaaatgacatttcaggcacttaaactttaaactcagaaatgacttttaaactgaccaaatgactttgattgtttgtgtctataaagatatgcataagattgctaggaaaattgaatatacagacagtacccctaacaaaagcctgaatttggcctatgatgtttacaagtttacaagtgtttattcacatctactttgtgttgtatattgtgctagattctgtaggacactacagacttccaagaaatcagaagaggttgaatcacagtgctcattagacattctttgccattttcaaaatatatctattcagatatatgcagatacagtctacgttacaaacctattcttaaatttaccatgaataatacagaaacatagcttatcaaactcataccataactgggaaaagatgaagtcatcgactctattacagcactgtttatagcagcactgtttaataagctcagatttagatagacaagatgacaggaaaaggaaagttttaaaaacttggttcacaatattaaagacttcatgggcgtttgggttaccctaataggaaaaccagtgtgcaggagaaaggttgtgactattcattactatatttttcttaaaaatgtacaagtttaggctgtgtttatatatgtgaaatcataggtgagattaataattatccatatactttaaaatacccaataattgctgcttaggaggaggttatttatttatttatctgtctgtttaatttgtttggaagatgtcaatcatcattactgttaatgaagcttacttaacaatgccttattaaggcctctgctttcctttgtaaatgttaccaaaagcttagcaagacttgggagatattcatgacaataaactgaaatgtttgcattcaggtttcaaatcaattatatgtttctaagtatgtttttatatgtaaaaagtattcagtaaatgtaatgcaaacttctgtaactaactggcaagtttaggtagggataatatgtcccccataatacgacaagataaaaaaaattgtttgaatgccgtttgcttttaagaaatatattaagatttgaaacttaaagttgagaatgtataagaaaaattatgccttgaagaaactcatcatgactcagaatcacaattttgttagaattttgttatatatcacagggataaaaaaaagttttcatgttgggtaattttataaaaattgaatgataaaatttgagtatggtctattttttttgataaatggctatgtaatatagagttttaataataacacccaaaagttcaggttcaggttttggctctgctaattactaactcttatagttttggttctctcatctataaaaaaatgagacagttaaatatctattccttctacttttgaagtgtagcatcgactgatatggtaactaactaactgtgaatgtacgtatagaaatgccatttggaagggcgtcttctgtcaaaagcaacaagtaaaaagagagtgctataaatctaaagtctgggcctggaagtaaagacagaaaattctccaaatagatttacaaaggaagaccttcctttttgatgggtttaaaaaactatttgagttgttttgagaatatttttacttagctatgatttggttagtcattaggggtaaacctagtagatagaaatgagtgttcagcaaactgattcccagatgaaagagaaatgatgtttatgtctgtttccagtgagactgcagtttatgagccaagacatgggggtgtgaaggaggtttccagacatgcaataggaatggaggcaggtactgttttatcaagtagtttagaacagaccattgatatgaccaactctttgattttgaaaggtattcaagtcaacttagattgtattgtagttcctaattagccatggcattcagggacaatggcaatttatttattatttatgttatgtgcatagcaagtcattggggggatttgtactgtgtagtcacccacaaactcatgctgactgaggctctacattttgtggttgcaccatttgggacacagaactttatcttagtggcaagaaaagacagtgactggagaaccttcatgggtgttccgaagccttatttaggaagtaacacatgtcacagctcattagtcacaagtgacattataccatctaactgcaagcaggatgagaaatgtgggcagcagacaagtgcttgatgtgcatcttcatgtgtaacacaaaataaatgttgcagaagagggtttcctacctcattctaccattttaagtttatagagttaaggtaattaaagcaaatatgacttacattactgaattcccagtgattctttttcttcctaccgtggcttctctgttttggcagaacttcagttcatgaggacctatttcataatagtcaaaaatacatcaaattctaatttatactgtgtcattggcacatagacatctctcttttggggaaagtatttgtaccgggctttctttgttgagaaaatttacacatatttatatttatattctgtaattttttctctttggaattttgttattaaaggtgatctatgcctccattcaccaatgctattttattttatatgagcccttttcaaattttaatctaacaattaaatttcatttcagcaaactggaaattcaggggtccccatctgtctttttaaaggtgaaaactaggatttcttttgtgcttgagcaaaaagctggacagccaataattctcttatttgttggtgaatgaggaatcaaaggttacatttataaatcactttaagagcataatttagatccttgttttgaaatcctctatagaatagtatatatgtaaaatgatcttattatgtctgtgtgcccatcataggtttaaagacaagttgagtacacaaattgatgtaatttggatatatatccctgccaaacctcatgttgaattgcaatccccagtcttggtgatgggggccaggtgggaggtgattgttcatggagacagatctctcatgaagggtttaatacaattcccttggtgctgtcctcacaattgtaagagagtttaaaaatatgtagcactttcctccttcctcccttgctcccactttcaccgtgtaaaatgcccgcttcccctttattttctgccatgagtaaaagctctctgaggcctcaccagaagcccagcagacatgctcagcaccatgcttccggtaatgcttgcagaactgtgaaccagttaaaccccttttctttaaaaattacccagattcaggtatttctttatagtaattgcaagaatggcctaacatataaagtgtccccttttgtgctctaagatacgaaagataaatttatattagtgcaaatctggtttgtatcatactctgttaacttgttgaggtagtatatgattgggtgagaataagctggaaactatggaatgtgctatttgcacaacatttgattgacaaaaatgcctttatttagatgaactaaagaactttttattatttaaatgtagtcatttgccacataatgatgttttggtcaatgatagactgcgtatatacaatctgataagattatactactatatttttatagtaccttttctatttttagatatatttagatataaaaataccattgtgatgcagctgcctacagtattcagtacagcaccatgctgtacaggtttatattgtaggagcaatagactatatcatatgtaatagactatatctattgtataggtttgtgtgagtaacactcaatgatgcttatgtaattaacaccctatgatgtttgcacaactacagtgacattcttagaagctatcctcatcattaggcaactcatgacatatatgcatttatttgtattaactgaaatttatacattttataatttaaaggatcatccagtgtgctcgcatagaatcacacctgtgctatgaaaaattataaacaaaataacaaaaagtaactgaatactgtttgttttttaaatatagaaagggaagtttagttacactgaagaaaacaggtaactattcatgggcacaaactgaaaatgaggggaacagattctctcataggtgaatatttttctttcctgagatagtagttttatatgtatggttttgcccagggactacccaagtatagagtttgtaaattgaatggttgcagtaatttctggaatccctataaactatgctaaatatgaaacattctaaatggttggaaagctagtccttataaatttagatactcaatacttagacatatttatttcaagtagttaattattcttaatttgctctgaattcttaagtgtaagaaagctataatgggacagagggagacctatatcccattttcagtatttcaaaaaattcagtatttctgaattatgacacaggttatttcatgttactcaggagctctgttgggtagtatttacataagtaaaactaaaaggaattttaatgctagcggtgcaatgttgaaaacaaactaaggctagttttggttgtatagggtgtagaataacattgccaccctacactttttagtttcctagctattaatttcaccaatgtttatttaaaagcatataaaagtttaattgatgctcatatcaacatgaagggagtcacacattaggtcctggattatgaacattttgcagaattagtctaggaattctgctatggaaagtagaagacatagaagaatgggtttggaggtgaattactggcttcatattcaccatacttattaggttaatactctttatatgtttctcaaatgctaattagtgatttaccttgacgttatataatagcagctgtcatcacatctcaatgttttgtgactactttttggctctagttgatgaaatttcaaagagatggagttgagtaggaaaagtgttggaaatctgtgccccttactggcccatgattttaagaacattagtgtctcatctgaaatacagagattaaatgaggattaagtgaaatgataatgtgtcaaggttttagtactctggcctgttacttgtttttctcacttaaagcgaccaggtcccgggaaataggaggagttaaaatttcttaaactttgataaatttttgttagaatgttgtgattttatgaaatgatctcttaagcgctgtcattctcagaagatcatgggttgtcttaaagtgcttttttctgttataaaatcttggtaaaattcaactctgagcaacaacaaatacaaaattgcctataaagataactagtttttattttgaaatagatatttattgatgaagaagaccttctaacttgtaccactcaagaagcagtgaattgaactaatacagtggaaaatgcttgtgaaaaagaccagcattcctttgactctagactaaaggataatgccacctgagcaagctactgaattattgccatgcactctatggctaattcttcacttattaattgagatagtaggcaaacgctctttcacagatgtgttatggattattttttattttattttattttattattttttttttatttttgagaccgagtttcgctcttgttgcccaagctggagtgcagtggcgtgatctcagctcactgcaacctctgcctcctaggttcaagcgattcttctgtctcagcctcccaagtagctgggattacaggcgcttgccaccacacctggctactttttgtatttttagtagaggtggggtttcatcatataggttaggctggccccgggctcctgacctcaggtgatccacccgcctcagcctcccaaagtgctgggattacaggcgtgagccactgcgtctgtccctggacctttttattgaactacaaaaacaaacagataactttcatttttggattactattaaatgttgtcaaactttattctttagggaaaatggaagtataccactatacagagaataactttgttatactcaaagatagaaaatactgccttggctagatgtggtggctcacgcctgtaatcccagatggggtttttccatgttggccaggcttgtcttgaactcctgacctcaggtgatccacccacctcggcatcccaaagtgctgggattacaggcgtgagccaccgtacctggtggaaattatcctttataacagtcaaccactgggttgtatggttgccctccagtgagatcctatgctacatttgagtgccagtatcctggaggagtctgtatcttagtgaaagcaagggcaattagggtattgtctacagtatgcatcctatttaactggctgtcatgatagaaaccgggagcaataagtatcacataagtaaaagctgttatctccatgtatatcattctccccacttttctccttctgccttcaaatctgagcagtctattataattttaggagctgctcttcctaactgaaatatattgctgctttccagctgctgcctgcagatacttaaaaattgaagcaagcctttcatttcatattatctttctaccaatccatgtgctgaggtaatgcactggatatttttgtcattcagccgagcaagggttctatttgcatgatttatcaagttaattatttgctttgaaacagcagacttagaaagacatctcacttctaggtattctgctactgaagatggcactgcattattgagttattgtactgtactgtccagtgaaaatttctggtagacaaaacctcccagtatttggaaaatacccagagctctgctcaagattcttcttttcacgtttttcttcttattgtaccatgtctgaaactttgggatgcatgacctcatctattaaaatttccctgtggttggagcagtgttttcattcagctgcacactgttgggttactctgaatatgtagcaggtattgaactcttcaactgccacaaaccccatgacccatggtgaactgaaagcaagggtctgtatgtagaagggagtgcaggagcactgccacccctcaccaccgatggtgtctgaatgggattgtagagtctggcctgaatatgccctctccttcagggccaaggaccattatagtaaattgtggttattataagtcaaatggaattgggtctctggtttatcataattgttttgaatttcatttggctgttctgaccactctaacttatgaaggaggtagccaattttgatgtattttagtattaaagttataaaactatattgaatttaactttgggataagctcacagatctgaagtaaaattgtcattcatacggcttcactgagtgggcctatcctgggtagatgctaatgtttttcatggaaatttgctgtgtgagtagagatggcaaaacgggtgactgaatgatgtaatgtctgtataacatcactaccacttactgttaaaatacagcagcacattatctatttacaaaggttgcactgatgaaagtaatggttacagttaatttggacagagattttataaataaatagttacaatatcagcataatcagcaataaggtaattgtaaggtgccaggaatggaaacactgtagctttcatatttctatcattttgaaaaacaaagacagttgctcttgactatgaatatttataattatttgggtggtgttgatgtcttctggctacaaagagccaactagtctataaatataaatagactgaggctgggaacagcgtgtacagtgacagtgtccagaaatgctgaatccttaagacttacagtggagctagatgtctgggatctggggtccccacctagacctgaaatgtaggtctcctccccatatctctctcctgctcctgcctttcttgccctctcagggaagtgactatttcctacatgatgttatacaactggtaaaaggcagttggtaatcagaggtctgtgatctctgtctttgtttctttcctgtgcttaatattgtgatatcatataaaactattaaaatctgaactctgatccatagctgattaaacagttactgagatatacctaccgagtgagctgacttgaaaccttgatttaatataagcataatagtagctaaatttcattgtttcattaggtaattgaaaatacaggcaaaagaaaatgtgaaggagaaaaattttatctgtttcttggttcaggaaggatggatccctgtgctctgtctcatcttaatggacttccagcctccatcctcattcttaaattgtgtctagaaattctcttttctacctctcttaggcttccccagtattcaaaccccagctccaccatggagttctgcctttgtgtaaagttttggaatttatatttcttctgctacttctctgaaacagcattgatacaattgtagaactagagaagctatatgctatgttagaaaaagcacaggactaaaattggacgcaggggtatggcttacaatttcaactctgatcctggttgtctgagtgacatagaatgaataaaatagttccagacccctattgttcatactaatttggaaagtgatctgaagtagaaatgtaaatttatgcatcatcagaatgaattgatggtgaagccatggggtgtgaaaaattatccatgaaacattgcaatttatgatatgagaaagaaaagaaacctaaatgaaagccattacttgaaggatggacagagaaagagacattaataagaaaattgaagagggtcatcagagaagtagcaggaaaaagaacaatagttgtttcgtgaagggcatgggggagggtttcaagaaggcagaagaattgccaatagttctcattgctttggaaagatacagtaggatgagaaatgaaaaatgcctaatagattcattaattaagggctcattagtgactggctaaactagtttcagctgtcagaagggtcaagaataaagttgcaatgaagtgagctcgccatgcaaatgaggaagtccgttgattataccttcaataagctcgattaaagaaaggagaaagagtagatctggacttgaattgttgttgttgctgttgttgttaaaatggaggagattctatgcaggggccagattagtcaagggggtagactaaagaaacaggagaagaggggtttaattgatgtttgatgtggggagagggactggaagaagataaaaggaaatgagaccttgcaaatagagagaagggttagccttaaacaggacaagtaacacctgggacctaggcatttctctatttgactaagttaaatatattgtgtatagactgattttccatttacttacttttcccaaagctatttgccttttaattgtctcactgatttttaacaatttcagaaaaggatgggttgaaaatgactaaaggaaaactgcactcagcagcattcttaaattgtgaaattctagtagaaaatatgtttatgtgtagaaaaattgggaactttggtaaagaatttctttttgtttatttttatttttatttactttttttattgtactttaagttttagggtacatgtgcacaacgtgcaggtttgttacatatgtatacatgtgccatgttggtgtgctgcacccattaactcgtcatttaacattaggtatatctcctaaagctatccctccgccgtcctcccaccccacaacaggccccggtgtgtgtaaagaatatttttttaaaaatttacttgaatcttcttcttcgttccccagtttttagaatttttacaatgtctatgatacatgcacctatacccacatgcatgtgtgtgtatattattaatattcggtaaagagaggctattttacacacaataggccctctacaaatatgtattgaatgtgtgttaaaggcacaaaaaatatttttttctctggataaggaaggtaagggaaattaaaagactgacttaatgtcaaatcttaagtatttttattctactattttaaatttcaaataatttagatagcatggatagaaatttattttttggtaatttgataaaatggtttgctaggcagctttaccctttattctcacttttggacgttgcataattactgaactcagttgttctgcatgtaagtgtaagaaaactttcatcttcacatcagaatatttggattgtaaacaacatttaaagaatgtttaggtgttgtaaaacaatgaagtcaatatactcttaagaattttagagttagctgttaccataagggaaaccagcttttttgtttctgtgaatataattgtaactctccagtaaagtgttaacattcattaaaacttttactagttgagttctggtttctgtaaaatatttgttgatgaaataatttcctttaagaacatgctataatttgcatgtaattacttcagcctgaccttgaacagataagggctgaccattggaggctgaaagcatgtgtgattaaaagttagtctagatgaaagtggcctaggcttgaatgtgagcttcatcatgtattagctgtgtaatcttaagcaagttagtttaaattcctacgcttcatagtccatgtaaaacaggaataatactagtgccctcatactgtcataagaattggatgagttaatacttataaaatgcttagcacattgccttactctttctaatcatgttaaccattcttattgccagttatatagatgcttatgtggtaaaaaagacatgaataaaaatacaacaaatttagaatgtgtgagatatatcgtaacattaaacatgtaaaggaggctgggcgtggtggctcacgcctgtaatcccagcactttgggaggccgaggcgggcagatcatgaggtcaggagattgagaccatcctggctaacacggtgaaaccccgtctctactaaaaatacaagaaattagccgggcggtggtggatgcctgtagtcccagctacttaggaggctgaggcaggagaatggtgtgaacccaggaggcagagcttgcagtgagccgagatggtgccactacactccagcctgggcgacagagtgagactcagtctcaaaaaaaaaaaaaaaaaaaaaaaacataaacaaaaaaccaaaatacatgtaaaggattaaatgctagaggcttatcccaacttagtaaggaatatgataattttctgagacataaaatatatgctagcttccttacggtatatttaaccaagaaaacaagggtagcattattcaaactactcttaatttttaaattcaacttttatttctgagataattataaattcacatgcagttataagaaagaatacagggagtttttgtgtccctttatccattttccctcaaatgtattattttacattttgcattaactgtagtacattatcacaacttggaaaccgatattgatagaacctgatcttattcagaatttaccagttttatacgcagtcatatgtgtatgtgtgttatttccagttttatcatgtgtagagtcatagtaactaccacgataatcaagatatataacagaattttttttgtcacctgaaggatcccttgggctaccttttcgtagacacagccccctccccttgttccttcagaaccactcatcattactcctctgtaacgtcacaatttaagatttttgtataaatggaatatgtgtgtatatgtatgtatgtatgtatatggtatgtatgtactatgtaccttttgggttcagttttttcaatctagatattcccttaggatccatgcaagttgtgcatattaatagttcctttattctgctgaatagtattccactgtatgccattatttatttaactgttttctcattgagggacatttttgtttttttctttttggctattacaaataaagctatgaacactcatctaaatgtttttgtgtgaacataaatttttatttctttgcaataaatgcacaagagtacaattgctatctagcatggtaaatacatgtttagtttcataaaatactgtcaagctgtttttcatagtggctgtaccattttacattcccatcagcaatgtatgagtaatccatcttcaccagcatttgatgctagcactgtgttttattttagctgttccaatagttgtttagtgatctcattgaaattttagtttgcgtttctctaatggctgataatatcaaatatgttttcatgtgcttgctaaacaactgtgaaatgtctttaatgaattgtctgcatttgctaaataaatagttttttttaagtgctgagtgttcttttattgatggttttcaagatttttaatgttctgtatttagtatggtaaataactgtgagtttgactacctcatttctgtatacatttgtaaaaaatgacagtttttttagtgttttgacaaaaattttcaaaggacattgaacaaactattttattacttattacaaagatttatttgcacagtttcaactagcatatcattttcatattcctacactactgagcaaagtgaagactatttgcagtcattataagatgttatatgtgctttgttaggggatactgctgtggaaactcatagcctttgagaatttgatgtctcagttgggatctgtctatgaataagagttctccaggcagagacagaggggagagtggtcctccatgcagagggaactccacatgcaaagacctggaggaatgagagtacgtggcactttagaggaaataaaaaaagttcagtatggctgcagcatagaccaagaagggcagtagataagctttgaagataggaggggcaggtcataaagacataatctatgttaaatactttatctttatactagggccaaggaagaggcaatcaaatctggactgtacagtgatctgcaactagaggtagttgcagaatgaaaaataaattataggatagtgcaactaaagcacttaatattgtatagtagtgttttacatttaaagttgttttagtgtttatgtttgttttagggtttctgtgatttttactaatggaatatttcttttttttttttttttttgagatgaagtctcgctctgtcacccaggctggagggcagtggtgcgatctctgctcactgcaatcttcacctcctgggttcaagcaattctcctgccccagcctccttagtagctgggattacaggtgtgcgccaccatgcccggctaatttttgtatttttggtagagacaggtttcaccatgttggccaggctggtctcgaactcctgacctcgtgatccacctgccttagcctcccaaagtgctgggattacagaattgagccaccacgccaggcctactaatggaatatttcaaatgattatatactaatcagaaggcccaatagaaaaatgtaaaactgactgaagttgagctacattgaagaaaattgagatggatgatctggaccccagaaatctgattccctctttcaacatccaaccagaccttgaccccatctctctaagcccctactacagtgttcctggcaggctggagtggactgcaaggagaccctttgtcattttgactatgatatttagcttttatttgtttcatgtaagtttcattgcacgatttcatttttgaaaagattctccatgaacaaaatgtttgaaagtttttgcccttagggttttgggagttcagactggtaaattctaattttaagaaggggaattttaaactctggggtacattttaaggaagaactaggtgagaaaatgagctaccaggaacattcatttaatcaatttacttgtgaaaattacatgagaaactgatgatctgtattttatgatattttttctttatttttgaggctgaagttctttaacaaacttttcagttatctatcaaatgttccttcagatatttaaggaattatagtgatgattttctctctctcctttttgtctgaacatgtcctgtttaaattcgcgttcattttctaccacatagtacacactaacctctctgcctctataaaataagaatactgttgatgtggatttacagatgtctttttcccgtgtttatatcaccaccgcttattttggcacagtaatgccaccttttatttacttaaagtgctaagattaggtttaaaaatctcatttatcaggcccttgctcttcaaagagtagaagatggtagaagttataactccaagactgaatgagtcatgtttcatctgtagactcagggctgtctcttttagattcctggctaatttcaggctttgcctcacttttatgattcatcagcacctagcgaagtatcagacatacttgtttgtagaggtgcttagaaattgaagaagagttgaagtaaacttgtcactctttttttttgcttagcttcttttaggttagagggctaagagtatgacattaaactggagataaaagactcaatttagtggctctaaaggagttaatatggtttgcacattgaaagctctactagctaacaggtaatataagcttgcttggtgataacttttcattttaagagtaaatattaaattgtgttcaaatcccacatattttggcctcatggacgtataggcccagtgtttgcattactttaagttattctagagtaactagaaataccaattgttacgttgaatttttctttaaaaacattggcttaaatatttacaaagcactgtgcatgtcaaacaaaacatttctggagacagattgcacctttcatccatctgtttggaagccttgatctagcatactcattactggattctatcagtggtcgttggattgatgaatacctttctgtgcactgcctctaccttctgttttcttttcctttttcctttaagggcatttgatgctgttgataagtctcctgttcttgaattttaacaaaattaccttcctctacttctacttttgcactccaacatatataatacctgctgattgcttcttacaaaacactgaaggctttaaaattaagaacacttttatatctgaccctgattgctacctttaatactttctaccttgctgtgagctagcccatgggtgccctgtaaaaatctagtgtctttgatcctccaactcctttttctggcctgttatttctggctcccatcctgctatttggagtttttatttctccccttctgccatccccatcaagtgaatgcatgtatcagtccatagacatggacttagtacatagttttcttagtacatgattgcctctcagtgctgctccacattctaaaactagtgggtggattgcccatatgtgctattcttcccgggacagtaatggttcatacctgtagcctgggaatatttattaatagtgccctgtttctctgtgcaaaactctgtgttttgctttggaggaagacttatgtggtcacctgacccataagtctcctataatcattaaagagtttccacagttggcaaccttgcccaaatcccaatgcttaaatagattttaaatgcttaaaatttccttattacccaagtaaaacagaacaaatagactataacgcctataccctttcaacagcacttcttttcatcaaaatttttcatgtattttacaaataaagcctatgacacaatgatttttttattcttttttttttgaacggtgtgaatatgtttctgtctttctctcccttataacagaatcagcttctgaggatatgctggcttgttttttaactaaggtggtaaaacagcagcagctctttacctaaaatattgcagtgggcacctctcacctcacatttcatttgttcaattatttatatttggtacaataaaagagaagataaggcagagatcatgaaagcattaaactacaatgaatttctgtattttcctgttgatataatctctcattcatctgcaattgtacattcaattataaaccactatccagggagatttagttcttgaaaaaaatctactagggaatatttatgggcaaatatatttcagtgttttatttcctgcttacacttgattaaatgaatatgcagaagaggtgtgaggaatggtaacactccatgattttaggtttgctatagtttattttccattgctctaggttgacagtgaagtgttgttcatgtttctggacatcagatttgagttctttaggtttctcttgggaattttgtcttatgccttattcatacttcttttcatgattttaccttcatttctttcttttctggtaattgccttcttatgtggaataagggagggcaagtatagtatggaaatctctgtttgcaaaagcccttagcaattactaacattcttagataggtggatttttattcgctttcttatttaataaggacacagtcatttctatgctgtggtgcctacatatttttattcatcagtagccaaattagtgattatttttcttatcagtgttcaacaggaagtttgatttactccacctccaatttagaagttaaacaaattgttatagagctttcaggttttcatacatatcttattaaagaaatagctaaaaatacttaataagtaactgaaaagtaattctcttcaattcgaccattatattggattatatttccagtaaaacttctcaaagaatggaaatagggaaaaataaaaatcgatcatacatttgttaacaaactaaaatatttcagtttacaaaaggaaacggattgtcattcttacagaaaattttgtaaacttatggctttaatattcaccatgaataaaatacaataaacatagtttttaagtacaaatatattttaaagatttggggaagggtttttgttatgttaatataatgaaaagaaattattttaatatatctaacaaccattttatttgcaagtgaaagacacttttttattggactagagatggtggatactgagttcaaaacttcatctagtagtctccatctggatttgactaaaatagcttctttttggcagaattttacattttgggtctttgcttaatcagatttgtttcttaatattgcgttctttcatatactgaattgattaattggaaaatttatttgtgttttatataaataagtatgtacttggaaataatgtagcctcatttcatgtttctgtaataataatgctataatgactcttgaatatttttattctccacagctttttataaaagtatatgtgttgtgtcaaagctacaatagatgatctgtacttgaaagccatatcttaactttttttgtcatatccttggggtaactgacatagtctaattcccataggtattgtatttctgataaagcaagatttcaagaacttagaataaactttatgaacaaaaataaaatcgacgtattaatgttgctattttatggaatattatgatggttgcacttttaaattttaattacaacgtagagatcggagtgttataaataaataaaatgtgggaaatttttagatttcttaaaaagtttatttcctgataatgtaacttagtagctcagtttgtagtgggttggatattaatgtatttctctcttttaaaaccatgttttacacgaggaaaaacagtaagtgagcttaaaaaagatctgacagatgagattgctttaccgtgtatttatctactgtccccttcccctcatacacatactcacatggggacttttacagtttaaatgaaaaccataaaggtccctggtataggtttgactttcctgcttcttaaaaacatataaacaaacaaatgaaaaaaaatcaacatatcacattgacccttcttcacggtaaattcatctccagtttctgcaagtttagaggaccctaaggtcctgcaattaatttagtcagttctttcagttgcctgaattagcaggatttttgtgatgccgtatgataagagagaaggtataaatagtcctatgataatatcattctcacggtcataaagggatagaagttccctgagtcagcatgtttacaaggcccctcttctcacttgtcttccccttgttccctctgatcccatcaagcttgctggtgaatcacacagatttcttttgcagtcagagatcaaggttaaaatagaaatttgtattattgtttccagtgagataacattatattattcatttattaggagctttatttactggtgcaggatctcaatccaaagcattttatatactatatgaaatagaatggttttccttttcttttgctgtcaatacaatgcagattccatgtctctcagtaaacaggcaaatcttagtgtttttagcattttaatcagttaaagtattgtcacttaagatcagacttttgttgcatgtaaattaatgttttcattcctttcctatttttatagggatagcaagcatgagattgtcatttgttgtagacttcctatgtgtcaagccttatgtttagtgctttgctgatgttttccaatatattcctcacggtaatcctatgaggcaggctgtattatctctgtttgacagatgaaggggctttcttccagaaaggggaaacaatttgttcaagagtgcacatttgacaaggaaggttccagtaattaaactggtttggtcttactccatttgtattgaagggaacatttacaggctgtataaatgttttatctttctttaagatctgtctgtttactgagagaaatagaattttcactggattaatttgttaggcaactaaaaaataaagcaattctatttcatgtaatatataaaatattttagattgggactttatatcagactattagtaaagttttatcatactatagaaaattggctatatattatactatagaaaaattttatcataccatagaaaacttcaacttttaaaaatgacaggattacttaagatcacacaaaaaagactgcttctctattttcatctttatctgtttccttctttaaatttaccttctttgaatattaatattttttctacatgtcacttaaattctatgattttcagatttttaatctataaaatatatggcacaatcaaatgatctcccaggtccctaaaaatcatagaattctatgagattgtggccactcagagcatggcagggaagacatcagtaatataatatccttgtatccttcttttctttcctgcttctgattgttattcattggaaattttttcagaaagcaactctataccaaggtgaaaggagtttctttcttgcaagataaataagacatttacagcctgaaatatataccttttacaatataacttaaaaaatggatacaagaggtattaagaaaaaacacctaccactttcctttgtagttaacgaagattgagtgcttctattttgaggattagacatatttaattttaatggaaataaggcttatacatttagattcattatctcacagcctttggtataacaggtaaggtttcattaaacaccttaatgggaaaccagatgtatcagtgagaagggatacaaatgcatgtagtatatattctccttgtatggtgattagcacatatattatctctccagcctgagttatgtactgaagaggaattctggactgcattggaggagaaataaattgaaaaacattcttgcttctcctgaagctaagcttcgcatcataacctaattatttgtttctcagatgttgggcttttctcaaatgtcagtgattcaattagccgatacttattgatccctgaccccgtctttagtacaatgctagatgctgtggtttgaagtagtacagggtattgccatcagcaagatgacttgtcttcttgaggagatcgtgaacatactcagaataattaaacagatgacaggatgagagcagctactgtttatttgatacttacattatgccactctcagagattttgtttaatatatgtagtgggaacaaaagtgcatctttttgcctgtatctaaatgtgtaattctctttggtgtcaaaccaaaaaaaagatatatattccatattaaaaagtgcttaaaatagcattcactgaagactccctcagatgtatgtgtatgaatacatgtatctatgaatttatgtttgaatgtatgtatgatatataagtggaaaaacttgcttagaaagaactctctctgacttcttaaagtcctacatcacatagtagttactctgatttttgtgcatctccaccaaaaaaaaaaaaaaaaaatcacctggcttatactgagacctactttccccccccattctcctacattcaggataattttcttctgttccccaggtaactttttaccctttatcatataatcaaattgttttctctagattaattaaaaaatttcccaccattttttcttctgtctacagaggtaccaacaaaagctgagcagtgcagacaaaagtcctctttagaagtgaggggtgggccaggcacagtggctcatgcctgtagtctcagcactttgggaggctgaggcaggcagatgactttagcctaggagttccaaaccagcctgggcaaatgacaaaaccccatcttttccaaaaatacaaaaaaatttgtcagtttgatggtgtgtgcctatagtcccagctacttgggagactgagttgggaggatcacctgaacctgggaggtcagggctgcagtgagccatgatcgccatgatctgccaggacaacagagggagacctttaaaaaaaaaatcacgaggagtgattggagggggtggataaaagactgaataatcatagtctaattttgttgaatcaggctgcatacagcctgattgtacgttatagggtatcatcttatgttttacattattttgataaacacagatctccaattgttagcgaattcagcataagaatcctgatgtaacttgagttgacctttaaaagatgagtgtgatttcatttactaaatggtgatgggagggtttctgagagtgggagcagtattaagtggatggtgagaggatggcataagaaacatattcaccttggtgctgttgatcaggatatagtcatttacccatttagaatagagaatccatgtgaggaagtttagcttcgttttgggtgagaagaccaaggcagtattgctgagatactagaagccaaagcacgttctatcaaatgcttggaacacttgatagaataaacatgttctatgtatggccccaacattcctataaggcagatagtattatctctcttttacaaataaagagcccaagtctataaagagggaagtgttacgaaaatcacttaacttataagttctgatgccaggatttgaaccaaggttgatctgaccccagagttcactctcttagctataggcttagaaaaacatacaaaattgcagatgtttcttagcttaagatctgtcgtgtttatttcagctggacttgggagatataaggactttggctttgtatattttgtcaagcagctaaaaatgcaaacaactctgtttcacgtaatttatgaaatgtttttggataaagcatttaacagctgactttctatttaaattcctcatttgaatggagtttgttaatagaactttaactgtgctatagagttaacctttaagaattttttttatttaaatgcattcatattctagttctttattttattttttgtctttaaatgctagaaagccttgtgatactcttattaatgatgaaaatattgattcttttttcttttctttttttttttttttgagatggagtttcactcttgttgcccaggctggagtgcaatggtgcgatcttggctcactgcaacctccgccttccaggttcaagcgattctcctgcctcagcctccagagtagctgggattataggcacccactgccacgcccagctaatttttgtatttttagtagaaacagggtctcaccatgttggccaggctggtctcgaactcctgacctcaggtgatccacctgcctcagcctcccaaagtgctgggacaggcgtgagccactgcgcccggctgattcttttttattttcatatagacatatatatatcatctgtcttactgcgttacgatatccagaacaacattaaataaaaagatagtagacatcttttgtacattcttgattctaaaagaaatgtttgtgaattttcaccactgaaagtgttgactaatacagtttttggtagctgtactttttcacaataagaaagatttaattcaggcagtctctacccaccccacccaaaaaagtttcttctttgaaaattttctgtaataaacctgttctttaattttttaattgtttttttttagaaatgaggccttgctatgttgcccaggctggattcaaactcctgggctcaagtgatcctcctacctcaggctcttaagtagctgagactacaggtgtgtgctactatgcatggcttaaatctgttctttagaaaaaaaaatttgtagatatttcttttgaatttataatactttttcccttggctctaccattttaattttgttcacaatttagattttattttgttttaaaactgagaatcaatttacaatacacttctatataatttatgaaaatgtattagagatccagcacactgctattcagggtggtgatgggacagaggtataactacataatgagcctttttttttttgtcataactgtgtttagtttaaatacttcaatactgagataaataaccagtacctggctttaatcctccttggatctggcttagtaggcaattacaattgaccatctccattcataattttttgtagaattggcttttggggctttggtgaggtagagtaggcacttatagaaaccttggtctttgtaacaagtagaagctgccttcatgttactaattattatttaatttctataacttaaaaatttttttgtgtgtgtgctgaaacctaggatctattttctcttctcttctcttctctttttttgtttgagatggagtctcactctgtcacccaggcttgagtgcagtggtgagatctcggctcactgcaacctccgcctcccgggctcagacgattcttctgccccagcctcctgagtagctgggattaccagcatgtgccaccacacccagctaatttttgtatttttagtaaaaacggggtttcatcatgttgtccaggctggtctcgaactcctgacctcaggtgatccgccagccttggcctcctaaagtgctgggattacaggcgtgagccactgcgactggccgtatataccttcttatgccttccattgttatgtaaataatttgaagttacttatcactaagataattggccacatagcaaagagaaataaggaaaaatgactcttgagctgtaggaatgcaaatataatttaaaaatcaagtccatgacaaataaacctgtattctccaggcagtaaggcctacgttgctgttctagttgaaacttaaatgagatactaagctttctggtaatcaacttgaaaaggaatcatacaattagttatttaattttcactttacttttttaatggcaggaaagcctttcctagcatcaagttctaaacctgcaggcaaagacaaaggcatagaaaataaagtgatggttctttacatgtttcaagggggtaaatatcttgaagcatctttttgaaaaaatgtttttcttcagaaaaattaaaattatggattttctttcacaaaaattaatttaggcctgtgtacacataattttattccaatgtaccttttggacttagtcttttcttaatctacagttattggtattgtgtgtgacaaattctgtttgagtctgagtttattactaagtgagtgaaggaaatgcttttcaaactacaatgtgaatgcagaattatctgagttacatgaggctttttgaaaaaattacatatttttaactttctgagtctaaaattaatatacatatacttaagataattatttattaatcattgagaaataattcagaggcattatttgcatttgtgtttatgttacatctgctaagtgaaagggtgaactgtatcacattttagagtacatatagaaaaaaaatcaaatgtggcaaataacacataccataagcatgcaaaatttataataagctgtgagatactagctgacatcatattgatgtttttaaagcacagatattgtgcagttcctgattttgtacatattaacttggaaaagtttactaacaataaatatagtaaaacagagaactgtttttattaaagcagatttaaacttttcctgttattttggaatgtactattaaatctattagtctatcaaaagcgtggatcagtggctaaaagttaatattaaagaaaaataacaaaaattatgatgacattaactcaaatgatgtttcattatgatcaaaaccaaaagaatcaaacctaaaagtgaaatgtaaaatataaaacaaagaagtacctatttgccactcttaaatctatttgcatttttggttccacaaagcatcattttatattaaataacaaaggatgttaatttaaactgtattgattttatacatgtgttgtatgagtaaacttatggtatgttaatactcagatatttatctgtgcagagttcaacttaacactgaggtctgtgagaaagttttctttttcaaagcttgggattttactcatgtttgagaaacattgaattaggagtttacccttaaactctaaactctttcatgcccatagtgaattaacagagcatgctttcttgtacatttagaggttgttaaagcttacccagttgctgggtctgctagaatggggggattccataaggaaatcagtttactgagactggtgtctgaaagaaatgttcatcaacagagaaagtcttgaagccctgtctggttgccatgtttatgctgtgggccatatggttatattctgagagtttgaaccagtgaactcttagctatttttaaaaatttgatagagatccaagaaatggtttacacttagacaaagtgacttattttaggaggctgttttagccactggagaactccaatgcttcttgaagttctcaataaatctttttagtttgtctaagaatcagatccttagatttctgcgtcttctttttgcttagctccttaacagcttgaccctctttcaccaccactctcttttactggttttattttggatgggggtggggtgatggtagcaattctgacctttggattttagtccaaatattgattctgggcaactagaacagtggccaaaactacctctcttactcaccctaagaaacttggttgtgggactacagctacctataaaagaagaatcagatgtcctgtggtattattgatgtcccttgtgggaccttttctaagtctaaataagtccttagggtcaagctgtttctggaagcctggcagaaagtttatctgcagcaatttgtcaccatgagcttacttgttagactctcatttatttacttatgttcattttcttaggtacagaaggatatttttttttctgtgttccaggaagcaatttttgccaaagctaccgtggggaggaaaattatgattgtgtttcaatcacaattagttgcaattttgcctctccagatacatatgtgtgttgtagcagcttgtcagttttttcttaccccaaacacattgtcttttgaattgaatgctgatcaggataaatatataacacactcaaaggggaattttggtcttatatttgggaaaaatacattagtagatggctactcagattcaagatgtgtttagtgagggtcaagaggtgaatatgcttcagatacctgaattagttacatgggcttgttagtgcaagattaaatggctttaatttaactgccgatagagtctgttgtgggttcctggaagtcacccaaattgttaatcactattgaaataacatattggtaaaaaataagaaaatttattaattttaaaagttagctgtgtaagttagaagcttagaatgaattttatttcccttgtcctctgtagtattttactgaaaaaaggtttgtaatcagattgctacattccatgctccataataaaatacagagcagcattattttgataaagtaaattgactcttatattttatttataaaatatttaagatttttttgaaaacttttcaaaagcaaaaaacataatagcattatgggatttatatgtgtaaatgcatatgtagatgatttacaaatatgtttgtagcatctttgctgggatgtctcaacaaaattaatgcctccccttctttagatagtatttgtttttgtttacggcagtttttcctatatttggtgaatctcttgccttatgagtttttatagccccagaaagaagtaaaacactcaccttttcagccatccttaactaggacatcaacaggtgaccaaatcacaattcagaatacctataagaacattgattaggaagctattgagtaagaggaggcagcataaagatttccttctgcagaggggaagcatagacttccaggggcagcaaagcacaggacctagcctgagtgttgggagaatgttgtctgcacccagcagtaggtctccactggtggatatacttgagttattatttgggcttcctaatgttctttaatacttttttctggttgtttttgctgaaagtgatacagtggattctgctgtttacattgaagaacttgaactcatctttttcccagccttgatcttcatccagtgtaccatggctcagggaatggcactgctatatatttgggtgtagtaacaagaaatatagttgtatattctggatacctgtctcttgtatatgttatgcatcaccaattttgctgtttttacctcctatataggtcttgattggctgcttcacatcacctccatcatctattactataattaaaaacatttttcctctattgactgccacagctactatcttcctggtctcccatacctattttgcttaccaccctatcactcatatgttttatacattgtggccagagttatttgccagaatgaaaatctgacttatgatagcaaccttcatctcattcagcttaaatcttttctgtgtttaactataacatttaagataaagacaaaactgtttatctttgcctgcaagtcctgcttggtctgtttacttctttgatctccattgtcatcttccccattttctcctctgcagccaaactttcagtctcttttattcattgtacttggccctcttctaggtcctttgcacaagtggtttattttgcctgaaatgatcttcctaataactctctttcattcttcaggtcacagctcagacatcactttttcagagactttctcaccttcctgatgaggtcatatctccccattacatgatttcatagccagactgtcttgtgtagaggtcatcacagtttcatttggcacacattttgttgttgctttgattactcgtgtgatgctgcatccatgcagaagaagccccatgaaggaaaagtactgaaatggtatctgttagagtatttcagattcatcctcatgggttttcaatgcaattttaacaatatttacatcacatgatccttttgctgataaacttcttgttcactttgataggtggcataatataggagctaagggagataagtttattgttaggttcaaactgagatctgagcaggttacttaacccttctccacttcacgttttcctgtacaatatttagcactttacatattcagtaactttctcactggaggattgggtaaattaaatatttttactgtcttaagctattcttttaattatttatatgccagtaagtcaccatcaacacttccactgatggagtatcagctttctgtagatcactacacagaaaggcctaatgagaggtaatagcccttaagaagtttactgctgagcttggaaaattctacacattctaacaaatacaaagtgggcaatgtaaatttgtttattaactaaaaagttgtataatcagacataagagcttatgaagaaggtaggaataaaggttcttaggggagaaaagagaatacaagctttgcaagaagaaggggcacaccaggcaaaaatgcttattttattattattatgaaccatgaactgttaatgagctatgaattcatgctggtggttcatggcaagttagcatggcaaggtttttatggaccaagtttgcgaggatttttgagcaccagatggaatgtatgattcttacttgtgcttgagcatgcagttaattgcttcaaccaatagaattgtgttgttactggtgaatgtgtgtcaccatcactgaagcaatcactactagttcatggtgtttgcagagtttaatccctgcttgtaggatcattgtaaaggaaaagaagtttttgtttatttgtttgtttagttacagaaacagttcttagggagatacttgatggtattttagttagaagaagaaaatgtttgagatatattcttgcttatggttattctcaagggagagaaatttgatcctgtctgtatgcttgagttgcatccatttagcttatgaatgttaatgaaagcctgaaagtatatcacaatagtagattgaacgatgtgacagtgaaatttttgaaactattaagtttcttcttccctcctgtaagagaaaaattacctcccattttcccagcgccttggggtaggggaaggacatctgtgcttgattgttggtctgagatctaactgttacttcttttggctgaagttattttttattttagtttctacagtacaccccagagggaagctttaaaaaattagtgtgggaactaaaactctacaatttctcaatgtttgtgtttacccattgagccttaagttagcatttatgaaaacattaaagtacaattctcagttgctctcagggcaaaaaaacaaacaaaaaaaaacaaaaaaaaaaacacactgttggaatggaggtcacttgcgtcatgcagcttttctggttatgtttaaaaggaatgttttgttgaaggaatatctttgggtgattgtatttgttaagacaaagttgaattaattgtatgctacaatcagagaagtatttgcttgctcttcctttcctcaccattggtcaatgtggcatttcataattgaccagatgtgttttggctattttttaaattttgtttttcaaaataactgcattgctagcactgaaagtagaatagcctatcccagagacctgggatatgatttaatattatactttgctcaattattggagaccactaattccattaaagctgccttaagttaatgtagactgaggggattttacaagggtttcaggttttttttttctttaagtatatattttataccaaaaccttgagctatagttgacgatcttgtgaccaaaagcaacagtctcaaaatttgaggagatggcaccattcgcttttacttttttatatcctaggatctcagtttcttttattatatttgtatggtttatgaagctactggtgagatgaaaaataaaataaccctattttctctaccaccctgttttcctctcttttctttcatcttctcagaacttaacattttaaagtgtaagcacttatttcatccctttttccttctactacttgagctcttttcttcattttgctatgcccagtctctcattttttttttttttttttgttatcattcccttttgcttttattttccttttcttgtcttagaacctctaaggcagaactgtttcaaacaagcagaccgatttttggcttaggtgatagtactttgtaaataaaaaaatgaaaagatgttttcctttgacagttcccacttccgtaatccttgcaacaatccactcaaacagtgcttttattatatctaagacatttatctgttccaggcctcagattttcatcagtaagatggtagagaggagacatagtggaaagtgacagaacgtggctgttaatttaggcctctgacttcagagcctgaattcttaaccatttcttttgtttgtttgttttttgtttttgagacagtgtctcactctgtcgcccaggctgaagtgcagtggcatggctttggctcagtgcaaacttcgcctcctgggttcaaacgattctccagcctcagcctcccgagtagctgggattacaggtgcccgccaccacgcctggctaatttttgtatttttagtagagacagggtttcaccatgttggccaggctggtcttgaactcctgacctcgtgaacagtcctcctcagcccccaaagtccggggattacaggcgtgagccaccgcgcttggccttaaccatttcataaacaggaatatgcttttatttgggtgatgggggagattatatttttccttccttttgaatatttcatgaagtgtcttttattgtattaagaacttcagtggacttaaagtttaataaaggaagaaacttctttggtggccaattgaactgcccctgtgacctgatgatccttgttcctgagaactgagttgaaaaactttgttcaatctgaattcttctctaattgatcattacttgccatttacttattcaggagagcagtgaccattgttacagttataaaattgaatagttataattgttattagttttgagtcacagtaaggtctagttgttcttcatgtacttcttgtactaaaagtactttagttcttctaggttatgttgtctgaaaagtgggaactttcagaataatagactagttgagttggaaggaaacttacatcattcagtacagctacaggcataccttgttttattgtgctttgcctcattgtactttgcagatattgtatgttttacaaattgaacattttggaaattctcacagtatttcattttgtgtaacaaaatgtaacattttggtaattctcacaatatttcatacttgattattgttaattatatctgttatggtgatctgtgatcagtgatctttgatgttactgttgtaattttttcatgcaccacgaacagctcccgtataagatggtgagcttaactgataaatgttgtatgtattctgactgttccacctactggctgttcccgtctttcttcctctcctcagccctccctgttctctgagacacaacaatattgaaattaagccaattagtaaccctacggtggccctttaattatcaacttaaaggaataactgcaggtctctcactttaaatcaaaagctaaaaatgattaagcttagtgaggaaggcatatcaaagctgagataggccaatagctgggcctcttgttcctgttagccaagtttcgaatgcaaaggaaaagttcttgaaggaaattggaagtgctactccagtgaacacccagatgataagaaagtgaaacagccttattgctgacagggagaaagttttagtagtctggataggagattaaaccagccacagcattcccttaagccaaagcctaatccagagcaaggccctcaacattgaggcaagaccctctactagcaaaaagataatgacttgctgaaggctcagatgattgttagcattttttttagcaataaactattctaaaattaaggtatatattttatatatcttatataccttttttttagacatgatgctattgcacacttaatggactacagtattgtataaacataactttaatatgcagtgggaaacaaaaaataaaaatttggtaccttcagaaataatgtgactaccgagtagaatgttttgactttgagaatattcatttacatagaaatcatagatgtgttgtgcactcattctctttagaccttcagttctggtctttaatgtttaacagtgttgaagtatatccagacaacaggtgggaattgttagcatgatttttagtcttcaggcagtttccagggaatacaggccacactaccttctcttacctttaattgttcatttcaatcttggatcttttggaaaggtgagtgatgattacaaaattggccacaggacaaagcctttattgccttttgggtcatgttactgattattttctcttaagttgcttttctttttagcagctacttctcaaaacttttcactactatgtaacataaaagctgtgcaggttggatagctgtaggagagtgccatgatttcagaaattggaaaaatcttaaaacaagagttcttaaacttagatcaatgagtcctttgaaattgttggtgaagtaagtgtgtgtgtttcttggagtgggcgttgaggcaacaatactttaaatttacttcagatttcaaagaaagagtgagagagggagggttatagaggaataggaaggataagactgagaaagaggcctgactcactttgggatgaaagggataggtagagttgtgaagggaagggttaagaaaggttatgaaggttaagtgccattaagttggaagtttttaagtgtaccaccctttaacattgtcatctcatttttaaacttcgaaagtattctcttcatacattttctagttttattttctttactgtttggtggaagaaggaatgagtacgtctaaaggaacaagtattgaagacccatctattcctctcgtcagtgtgccttcgcacatcatggaggtagtctcatttagtcctcacaccggacctcagtggggtgggcacttcaagatgaggaaacaagacagagaggggttaaattatttgcccaggataaacaagtaaatagatgtgtaggaagtagggaaaattggagtcctggaaggtactggaaaggaaatcaaaacctattataaaattagccacttttaaataggaaacagatggcactaatccttttaactatttatgacataggtttcctatgtcataaagatgaaactggaaattttgttcgtcaaagtaatggccaagtacttgttttttgtctccttaagatgtagtaggggaaggggattaaactataaaacaatgcttggccaggtttctaaatcttaatgtgtagtgtagcgggtaaattccatgaggacacccacttcctaagaaggagaaatttgctactttctactgaaactttcattttagtttttttgtgttgcctgaaggtttttagaagctattatcttaaatccatacatttttctattttcaaatgtaaactggctacctagaacaaatacaaagcacttcctcagagatcaagagaaattttgtcattcggactgtgaaggaaacaggtttatatttttacaaggcaatgggagggacatgtcacggatactaaagttgttggaagtagactcctgcaaagatgcaaattcagttaatttgaagtttgggggacaagtttactttttctaactttttctgacattttgtaatatttgcctcatactgtcttagaaacaaactgtatgatgtaggggatagacctcattagaagagaagcatccatcttaagaagtaatagaatgtaaaagctcgaagaattaaaactagactgtacaaaaagtgatggcactgatgtccgtctaaccaaattaatggagtattttagggttattctcaagattgaaaattttgcttattatcatttcaaattttactctttttttttctctttgactatctttgaaaaaaaaacaatacttaaaaaaatatttttgcttaccttcagtggagcttgccaagtttacaggttacacagtccctctgttaggggctggcgaggccaaagaggtttctaatcttaaaaagcttgcactagggttttggggatgcacagacagatatggtatattttgtacataaaagagcattatgtaagtgctatgggaatgcagggcaggaaacacaaatagatagttgtccgacttttttataaaacatccaacttcaaactgaatactccagaccttgttctagatttttggatgaacaacatacatgaaatcccaacttttcatggagtttttcaattaagtaaacaaataaattcagtaagtggaaagtgctataaaggaaataataaaaagtgatatgttagaaagaaccctggaaggaactactttaacagacctaggaatgctgcaccaatagatgaatgatgaaaatcagccagctgaggacagagcatttcaaacagaggaaggtccagtgcatggagactgagacaagcataaacttaggtgtttttttgttttgttttgttttgtttttgtttttgtttttgtttttgtttttgtttttcagaaaaaaagcccattgtatctgaaacatcttgtgtaagggaagagaggtgtaagaaataatgttggagaggaaggcaggcaccagatcatgttgaagctgaggggtggggctaaagagtttggattttattctcaatgcaatgtatgagaaagatttaaaaaaattaacctggctatgtatcagaaacgattgtagggctgctagtgtggaaatcataaaacttgctaggattccattctatttgtcctcctgagaggtaataggagtttggtaaaactagtggatatgaagagacgtgaatggattgaggagagagcttgaaaatagaaacaatgagaattgctagttaattaaaagaggaaagtgaaggaaggggaaaaatcaaactgattcctagtttgatcattgagtccttagttttaataattggttatatttgttgccacttaatcagatgaaaaaaatagtggtaggagaagaggcttgaaaaaaggaaatgaaaagatgaacgatatgaaaaggagggtaatggcattgccttcagcacaaaggtaatagcaacagaagtacttagagagattaattttataacaaagaaaaaaaatatccccgatgggctgagacccaaatcatgatttcacttgtcactcttctttctacttagagatcctgattattgcttcttaagctgtctgggcatgaagcaatattattgtatagtgtctttagtttttttacaccaacagtttctggcatgttctttgttactactgggaaaatctcactcaatgccaagagctagctgttttgcacagtgcgttggtgctttggtagctattcaagatggtctccagaacacataaaaatacttttcttatgaggatagaatattacttagtcctctgtactcctccgctcatacataacaatctgattctctgatgttgagagactagagtggaagaaagccctttgtgacggtcaattttgtgtgtcaattagactcagcgatagggtgcccgaatattaggttaaacattatttctagggatgtgtgtgtgtgtgtatgtttctggatgtgattaacatttgaaatggtacactgagtaaagcagatagccctcccactgtgggtgggcctcatccaatcgcttgaagtactgagatgaataaggagtaagaaatccctctgtgtctgactgtttacaagctgggacatcagtctcctgcctttggacttggactcagattggaacttacaccaatggctctcctggttattggactcagacttggacttgaactggaatttataccattgactgtcctgtttctcaggcctttgggctcggattggaattataccatcagctctcctgtcctgagtctggacttctcagcttccacaatcatatgagtctattccttgtaatattgtgtgtgtgtgtgtgtgtgtgtgtgtgtttatctatatattccttttctctggagaatcctgactaatatatccttcgtactagggtagaaaatttcaacttttttcatcttcattcttcagacatccaacactctggtgaaggattttgttttctaactgattttatagagtacatctttataccctgcagagactgaatgagtgaagtagactcaacataaataaaagcactaatagtgttctcattagagcagagcgataaaaagatttatgtatattaaaatatagggttctctacatgtgatccaaagatctctgtagaccctcatactctttcaggtgatccatgaggtcaaaattgcttatcaataacattgaaatatagttttccttttttctctttcattttctgatgaatgaatagaagaatttcccagaggttacataatgtatgatactacaacagattgaaagatgaagtaaaaatgagaatctaattgccttctattgagacagatactaaagagatttgtaaaaagtaaaacaatgcttattacttcttactatcttttttgtttattttgggaaatggttatttttcatgaaaatatagtaaattatgagatcattgctaatcttaaattattatttttgagatttttccattttaaattctaatatggtcaatattgatataactcagaaacaaaagctgcttgatatccttagtatcacaagtataaaggggtcctgagactaaaacatttgagaacctttgttctaatataaggtttcttatatataccagcgtgactctgacaaatacattaaatatgtacttccaaacattatactcgttcattaaatccttatgtttggaagcagcataaactagtttcatttgtttttctttttgttgttgttttgacattttctggtaatttatctcacatatagttagaactagtgctgcctcaattgttcatgttattaactagtgtctttgtctcctcattcaattggtaatctaactaatcaagtaacaagtgtttattagacttctactgtatgcaaagcccttgttagatagggtgccagttatcaatttattgccccggagcttaaaatttgtccttcattacctgccctgtcatagtagcacttgaccctttaagcggttctgctttacagctggcacagtgttaagctttgtcagtagagggcactggagagacacttaagaaagaaggatcatctattcttggttgaattgtgatcctaagtttgtttttagttggtggtactgcacagtggacggagctgtgtgcatgtagcagacatagtccctcagtgagcttgtagcaacaaacctggcctggtgactgccttgctgtggcacacacataccccaggcctcatgccactctgctgcagggagaatgtgtcctgtttccctagcttccctagagcaggattggctctggcctgagtgacccagcagactttatcttcccgtgagctgcaactgcaccttctttaaggaaatctgattctcagcaacctcccctgtctatattggtttctttcttgggtactttgattgttctttaaggttttcttcacagcgttaaagtttctatcttcttataggtagtaattctttatattacattttcactgttaaatttactgtgtggcttctctcttctgattggactctgaataattcaggtgctttctaagagaacaaaattacccttctgaggttgacaagagatatcccagtaaatcatttaaaattggcacaaaagcaatgtataattgggggccagaatcagacatttagaaactgtgagacagtttgaggacagaaaactggcatgatgtgtggagaaaataatgaggggtctgtcagactggagaaggtggtttgtgaagagaagtgggaggtaaaatgaccagttactttgggataagatcatggaaagttgtgaatactaggcaaagaaattgaaattttgcttttagtttatagggcacattcaacagattttaaataagaactgacaatacaaatattatgttagtgtactaaagtataccaacacatacatatataaaggagttttagaagaaagtatggaaatctatttatcatgaattattttctttgctattgatccaatttcccatgtaaataccttattcatagaagtgtaacttaaagataaaaaataattaatgtataaaatccatagggcattacatattcatctatatactagattatgttattttccttgcccattctttttagtaaaaactgtcatttgttttaagtcttctctgcctttctcttttttaatgaattggaataagaagtactcaatttttgtattgtgttttttgaaatatttagttatttataggatcctatttgtatcctataaatacaaatagaatttatttttaaaagatttaaaaaacacgcttgtgtttatttactatttatcattattcatttgattttcctcttgtaagatagtattcatgtagtctctgttttaataaaaatgtgcaaatctaatgcctattcattatagaactctcagaaactgtacatatgcaaaaacttttttgaaaacctagaagacaattacagcccaccagataatataccgttaagattttgctacatatttttccagtcatatgtacaagtgtatgtgtgtgcatatgtgaatatacacacatttacacagatataattatttaacacaaatatgtatttttcataagtgggtttaatattttataacctgcatattttacttaacatattgtaaatatcttccataaaatgttttaaaataatattattcttaatgactgcattattgttcattaaattgatttgctgtaattttgcaaattactgattattgaatattgagaatacttaatttttctctgttttaaatagtgtaatgagttaggcatcttttaaagctgtatcttttatacatacctgatggtttatttagtatacatttgtagacatggaattcccagatcagaaggtatgtatctctttttttaaaatatactttaagttctgagatacatatgcagaatgtgcaggtttgttacataagtatacatgtgccatggtggtttgctgcactcgtcaacccgttgtctacattaggtatttctccttatgctctccctccccttgcctcccaacaggccctggtgtgtgttcccctctctgtgtccatgtgttctcattgttcagttcccacttatgagtgagaaaatgtggtgtttggttttctgttcttgtgatagtttgctgagaattatggttttcaacttcatccatgtccctgcaaaggacatgaactcatccttttttatggctgcacagtattccatggtgtttatgtgccacattttctttatccagtctaccattgatggacatttgggttggttccaagtctttgctattgtgaatagtgctgcagtaaacatacgtgtgcctgtgtctttgtagcagaatgatttataatcctttggatatatacatagtaatgggattgacacgtcaaatggtatttctagttttagatccttgaggaatcaccacactgtcttccacaatggttgaactaatttacactcccaccaacagtgtaaaaacatcctatttctccacatcctctccagcatctgttttttcttgactttttaatgatcaccattctaactggcgtgagatggtatctcattgtggttttgatttgcatttctctaatgaccagtgatgatgacctttttttttatgtttgttggccgcataaatgtcttcttttgaaaagtgtctgttcatatctttcacccactttttgatgggtttgtttttttcttgtaaatttgtttaaattccttgtagattctgaatattattcccttgtcaaatggatagattgtaaaaattttttcccattctgtagtttgcctgttcactctgatggtagtttcttttgctgtgcagaagctctttagtttaattagatcccatttgtcaattttgggttttgttgcaattgcttttgatgttttattcatgaatatctcttaaaggtcttttatgtcaaattgctgtctataaaggttgcacttaaaacaaacaaaaagcatatatagttttctctgtgttgaatgatatatttgagaactctattgatcaagagactgtaaggaatatttgtaaggccactttaaagaagttttaattaaaagctagtacattgtatgtgtgggaacatagatgttttattaagccttgagataactaaactcttgttagaaatctgaggaattagttagctggtaacagaacaatcgtaaataagcttaaattataacataaagtatgagagaagtacatattgtataatttcccaagtgtaaggattgggagccagttattctgggagactacagaagtgatttttagatgttgataagaatagcacagtatcttctgtgtttgggatgatggaagggaattttgtttcagacaggcagcttcctccctagtgcctactgggtaaattgccgttatatcaagtcagtaggcagaaagatttagatggctttttggtgctagtgctttcttcctcctttctggaactgtgcaataaatgcattattattccagagcactcggagaatgtggcagtagtcaggcattattgaaagagggccatttagcggaaacattctatagagatgaattatcaacactatttttctttattatttaacttgcttgaaatgttgaaatagtgtagacaagcttttattttgtgacttttgtcttcctagtgatcaaattgataatgcctacaaatgaatataccttgcccatccggtttccctaataagacagataattattgtagcttaagggtacaactgactgaaaattcctaaatggtctttatagtaaatattatgctatataattaaaatgtgacacaaagcatatttttactccaaagtttattttataataggaaaaaatgactattagaaagccaataaatcatttagagattactactttaaagttgacattcagaagccataattgatacagacctctaaaaataatttaaatgcactactgccataatattccactgaggggagggggtggaactgttatagtagtggagaaataggctacaggtttgtgaagatgctgaggcccagtaacaaacactaggtaacttatccaagatctcagggctggtcctcgttgaaaggaatgattggtctgctatgcagtggcaaatctgaaagacatcttgccaaatcaaccattgacttcagaatgtgaatataataaagaatagaaacatcctgcttctataaattgggttgggatccaggatatcctttttaaaaataaagacataatttctccaaaatacacacggacagtttattctattaatgtgccgtctgtgagactcagaaagaaagaaagagagaaaaaaaaaagaatcctagcttacaagagaagatgataactaggaaaaagaagtgaacaataatatcagccactatcactatgatctgtttattctgtacttcgattatactgaagtgttacagaaatcttcccaaaagctctcaaccagaggctacctaccactcagtggcaatcggtcacatttgaaatttggcttctcaaatagttgacaccatcctctctgccatgatttgcatctgttgttgagggttaattgaacaagttagactagtagttattgagtggttaatgtgtcatgggtacaaattttggggagggaatgcagaagattgattacttttacatgttgtcaggaagaaagggtcaagtgcaactcttataacactgagttttataacactacatctgatatattttggttaaaattacatgctagcaaagaaaaaagatattttacaataaaatttgtgttccatcttctgtgtaataaataggcatatttgcatttttgtgatatgtgtctttgttaaaatccacaatgacatgagaacaattggttgtcttactggagagttttctgggactaaaagcagcagcccgttgttcaagtctcatttttgtacttagtctctgtgtggcctttgtctgcaatggaaagtctatatgtgagctatgagagtgggactctatgtcctgtgcctcctcatgacagataaccaatgaacacttactaagtcaaagggatagagtagattggtgattttaaactgggtttcttgtagctctacaagagtttagggactgttacagaactggggccagtagcagtggtgattagctgacaccttagtgggtgagactccaagtggggaaatctgctgtgtcctgatcctcagctctaggcatttttaactttagccctcatactgacactacaaagtgtcctcattccctgaactgaggttcaaagttagtatgttacaaatgatcacataacttgtataaatgatgattttccaatacgaaattagaaatggttccattgtttgcactctaagcacatctccctgcaataatattctggatagcgaaaaataaaggtgtaccctttgtgtaaaccaggccaataatgtatcgcttttgtgtatgtgtgtatacatatatatatatattatattaaaagacttgtgttcagtaataccagagatttagagtgagatctggatttgaacccagctttgagtgttactaattgtgcctcaatttcctaatttgtaaaataggataataacaggttgttgtggagactaaatgaattgatacagaatgtgtactttgaacactgtctgttacctagtaagaattcagttcatctacttatttgattgatgtatttctgtggctgtgttctggaaaacagtctttttaacttaaatttaatgctcagaatggattagcatatttttattgttatatgttccctttgcttatatatctctttagcattattatttgtaatgtcatttcaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagtacccactttatgattctgtgactgagtttatatgctcttaacaaaaaaaaggttcatttactagtttggagagtttgttcagtaaccctcactatgaggttccgtccctggatgctgttatttctttaaaaggtcaattttgtgttagaccttgagatttaaacttttaaaggacttgtttatttgtagcttattataaagcctaaagagaatacatttatgtaaaagtatattttatgatggtcagcaagcaatatataaactaatagttttatttctgccttttaaaaatgaattatgtctttaagttaggtttgtctttattcttgaaggggaaaaaagaaatgctttgctttaattgctttgtcttgagttgagttttctgttttattaaaagcctcctacattgtaggcatggttccacaggtaagattttcagttcaaggttgtatgtttattgagttttcaatggattttcattagatacaagttgattctattattccggagcataaggatatttctcttcagtcagagagagccatctgctttttcagggtccacagccccaggagggctgcatatatgatatggtaggtaggtggatgggagtgtgtgaaactaatgctagagcacttgttgcaagatcagtgggctcaactctgacaaaagtgggttgatggctgtcatcaccaggtcactctcacaatgcattatcattgtactgatttcatgagaatctgtcataggagcttaacttagcactggaaagaagttctgattcaacagagtcagcctccacaaaacaaattaaaacccccaataaaaattaatctagcacactccttaaaaatatgggttttgaagtcagattgcctgtattcaaccctgttcacaacttgtttcctgtgtagatagttctttaaggaatcagactgtcagttgtactttaaaacaagaacaataacaacatagaagtaactgttgataaatccagcaagtagtatatctgtgatatatttctttttcctcgtaactacgaaataacatacatgtagttattttttctaagttgttaaagatctatctttgaatcattgatgttaataacattttctcatggcacagattactgtggtgttaattctactattaagttacagtaatttgaactggattaataattctttgttcagtctcattttgcatgacaaaacccccttcgttatatgtgcttgtggtgtatttaagcaagaagtacaaaaagtgcctgggtgagttccagcctggccagtgacatcattttggagatgttttgtcagagaaaatgatgactaaataaatacatggaacctatgggtaaatgtctcattgttgcagattaaaatttgagccatagataatttcttaagtgattgttttgctctcacatctttttccttaacctacaaaacttaatcaatgagagcaaacaacagagtactttttattcatgtgcttagtgctcagtaaattacttgtttgatgtttttatcaatttaatcatttagattattagttgtacctgtacatttgtgattagaaacaaccaacataacataaactatatttatgtgctttctttctcttggaaagtaacatgaaaaacattaaatctcccatacattttgatagctttcaaagtcaaatcaatacctgtgaagtgtttggtaagtgctggtttgctggcaaaacacggtagaattttttgattggtgttttaggtgctgatgtctctatatttaaagagaaactcaactgctttaaataccagatattggaggccagtcttgagattccatcaggttcttaaagaatatccccattttcttttattttgaaagcatgacattcttttcaagttttttatttattgtaacatctactattagacacatactgtgaggtcacatcatgctaactcctggggatacacaggcaaagtcccttttctcatgaagttctcagcctagctttgctctgtagaagataaaaatgtaaatcagatgtttgctctgctcttaaggaggctagtccagatgggaaatgcgagatatacatagatataacttgaaataccatagcgatggttaaatgacataagagaggtaaatataaaatgcagtggggaaagcaaaaacaaaagatagtttagtttctgaagtaatttcaagtagaaatgagactagaattcttttgtcgattcctctattcctagatgctttccactgtactgtgtatttttcttaaatcacacttacttagagccagcaaatgtaaattttgctttttgacatatcattacagtgatccactaacatataaggaacaaactgtttttcacctatgtgttcagaacaatcaatgccttttcagcttactatactaattatagaaattatcgtattacatttgttttatttgctatggttgaaagatgctattctacgtattttatgggccacaaataagtactgtagattcttaaattgattgctaaatagaagtaaatagggaaaatcccgcaaatccttaggtgtcatctccatattaaatttcagctgaagatcagcatacctctaaaagcgtaattttctccactctggaaatctgacctgtcttgtattcataaaactaagttctgctttgggattaaatccattaccttcttactgaacagtgaggttgttactaaatgaggcaggcagacgtatgtaacttgcaaaactattagtggaaacctaatctactgttttccattaactgggtgcccatcattaatcacaaaaatgatgtgtgatgaaaactacaggggtttgtccagaaattggaatgtgatagtatagcagaaagtgcctttttctcccccaatacatggagaaacaaacacaacttttgcaatgcattttcttcttaacattttccattggtttgaaaaaaaatgtaagaattgacaggcatgagattttctgtttttgtctccttttaaaggggttatattaatgtatattatattgatattttgtcagtagaaagattgttatactccagagattccactggctttggatctgaaaagattggggcttaaaccaagtgaccatttttacttgaataaaaagcctctaaaagattgatcttcaggcacagaggcctgtgtaagaagaacatactcatgaaccatccatgcaaagagtaaaaagaggggatgtccctcctctgtcatagctctcagaactcttccaatttttttgctgatctgcattcatccatatagagacccactttagaaagacaagcagcaggatttttttttctctagatatatcatatagcggtaacttcctgcataagcattgtaagtgactctgctcatgatcttgtatagcagtgttgtggatattgtttgttgtctatttattagttattctcctagctttcttccatagtggcaggagttccaaccagcttacttgctttcccagcttctttgtaggtaaggatggctatatgcgacacagttctggtcaattaggaaggaaagtctgccaggaaacttctgggaaagatgttcctccctgataataaagagagtgttgtatgagaacatggctcttggtgccattgtgatcattttgtaactgcgaggaaggaaatagctgacaaacagggtgacagaagaaggcattcaaggagcctgggtcctattctcaaaataataataataataaaattatttaaagaatttttagatgactattctcctgtgcagccaaaagcattgttatacatcatgttgtgtcttaagctttcaagcaatactacctgtcagcacatactgtttgtggatggcacatatgagacacgtggcagaatttaaaaaaatatatatctaccaatgaatgaagcagtttttttttttcaatctatttggagagagaagacttaaacagggctataagacagtggatcactgactaaacaggctagaaaggaaggaagaaagatgatctattgggtatctactgtgagtgggatactaggctggatactttcatgtttgtcatcttttacttgtattaatatttgaacgtgtgctaagtaaatgtttcttaccttcatgcacagttgaagttgtgcttacgtagtggtggagcaatattatttcccattttttgtctttagtaaaatagtatgatttttatgagtttggtctttagctgtatcagtgacttctgaagttagccacaactagatagacttattttagttacggcaacaggatttacctaacacggtcatcgtggcttatttttacactggcaaaataccttttatttgataggctattaacaaaacatctttgctgctactttttaatcttaacgattctctttgttgcaaacagagtaccccaaatgggttggaaaggccctcatattattatagtcattgttttcttgaaacttagaatcctgaaattagccgggcatggtggcgggtgcctgtaatcccagctactcaggaggctgaggcaggagaatcgcttgaaccaggaggcggaggttgcagtgagtggagatcgcaccactgcactccagcctgggcgacagcgtgagactctgtctcaaatttaaaaaaaaaaaaaaaaaaaagaaaaagcttagaaccctgtgaaggtgacctctctggttcctgatggtgatttgcttttattacaaaatgtctgctctactttgactttaaatagttgttgttgattcattgatgaaacttatggttgtgtaaataaattttaacagatgaacaaaagagccctggtagttaacagaacaattaatgtaaatctgtgacaagcctcttttcattctgctcagtcatacctgcttttatgtagggtggtggcagctgccacagtacccttcattgtttcttttgagaaatatttccataaattagtccaattccctttcagtaactgattgaaaaataatgagcggtcaggagaaataagcattgtttgttcaatgcatgattttttcttacttaggagtttgttttatctaaggggaatgaggaagacagatgctaaaaggagcagtggaagagataccagttctttgcttatgttctcaactagcactcactttggtttgctgaatctgaaaaaatacatttctgatttcttgttttgcatacttctttattaattatttagcgtacattgatcaggcagataaatgtgagaaccatttccgtctaatcagtttaatgatgtttctgacaatgctatactgtttcatataatacatgacaaatagataacaatttaaaattatttttgtcttcaattatgttgtctgctgactttgatagttaattggaattggtctagtttttagggctttccagtttttgaacaacttgaatttttgtgtgaactctgtccattttcatttcaaagacttatttttcttcacttcagtgtgtatataatatgtgaacaaaatattggtgttataagggacaaacaaaaacgaatacgttttttatctaaaatttaacttttgtgctgtggtgatttcagtttcaattcttagaaaacaaatacatttttcatttgagagaatgtgggaagaaggaaatatacagcaaatgtcagacatttgtagtcttttcaattttattattcattacataatattacatagaatctaattattctgttgttagtggggttggaatataaacgaaaacaaactttggacactaaattttactcatgtaatctagtggacaatttatagttaattttagctgtcttgattttcaaaaggtgttcttaaaactatcattataaaactagctactacatgttatttctgcatttagttataaataatcattgcacacaccactggaattcccttatgagaattagattcttaatattctttgaatgatctgttaaaaaatcattcttctcagccctctagaagcagtaaatcagttcacattttatgtttaaaaataaggtctatagtcaaatttataccaagtaataattcaataaaataataaagaatgaaaaatgtctagtacctagagacaaggtttggttcaagcttaaatatctttagatcctggcattttgcaacaacatcacaaatataataattagaaacagataccatggttctctgggcttatatttattaaaagacacttttggtttggttgtaaactttagtaatgtaaggcttacaaagagatgaagtcaatttagctccataaataccaggatgaatttctgtgttttgtttttggttgttgttcctttgtttgtttgtttgtttttttctttcatttaaccccctctttctatgtcttggggggttggagtgagacccattgtaagcagaacaataaagagaaccaaataattgtttttctgatacgtatattagacattgtgacatgaagtgtgagaattagaagtagaaggtctccttttttttttttttaaatagtggtggagaaaaaagtagaggccattttgtatattgggtaaaggtttggattagttctcatttgacctgtgtttaatatccattatcacatgttcatgtccattctgtcaaggcctccttgctcactgagtgactatgttgtgggacttcttgagtttcagtccctgcaatatgggatgatagctagtctactgtgatttattaggttcacaaaattgtctatttaaagctcttatttaaaaataacagacaccaactagagctagttaagtagaaaagagacagaattgaaaagatttgggaatcactcacagcatttaagggaagtggaattcccagcctgaagaaggcataggacccaattagatctgaagaaaacagaaacactttctctctgaaggactgctgtactgacttatttattttatccatttggtgagtggttattgagcaacctaatccatgccaggcacccttctgggtgctggggttggacagtgctgaataagtttcaaggttcctatagtcccaggaattctactctaggggtcagagccagtgggggagaaaatccagataaataaatgagaaaaagattagaatacaacaagtgctaaagaaataattaaaatttaaaaaatatgaaagcagaagtcttagaaactgcattagaccaggtgttctaggaagaactgtcacctggagatctgaatgacaaaaacgaactaggcatgcagagatcaggggaaataccttagagacagaaaaaaaccaaggacctaaatatggaaggaaattggcattgcagagggacagagacagatacagaggtcaaaggttacctttttcaagatgagatgggtagattccagttatgtgagctttgcaatctgaggaaagaatcctaatgctttcagataatttttatcaagggaccctatttactcattcttagtctcatcttgtacgtgcttcccatttatatttttctttagtcttttttactgtttactcacagctctgattgtgtctggtcttgataacggtaatttcctattttctctcaccttaaaatctattataagtcaattacttgttgggagatgctaatttgctgatattgagctcctcagattttgccagtgtttcctttaaagtcaaaacactcagcctttatttgaggtccttcgtcatttagcctcaggcaactactctaatctttctaccattcttttttttaggatgtaatatatgtatgtcctgaaatggctttgtttcttccttttcattgtccaagttctgtttgtcctttaagacccaactttatgtccacttctgccacgtagcctttgcttaatacctctgcactcagtggtctctcccttctccttggacgtgtgttgcctgtattgcttattagacattttgcttgttatatgtatttcaggtatttttcctccaatagtattataggccctcttttaaaaaggtcagggtgtcccataaagacaatataacaattaggtgctttatatttcagaaagcaattgtacaaattttaaaaaaatcatcctcacaatagcactatggggtcactgggaaaagtacaactatttttattttagagataagggctgacagagggtaagtgacttgctttaggtcttgtttctagtgagaatagagctagccctcctctctcttgtgaaattctagtccctgtctcctgtgccagactgtatattggtgatgattttccagtcttggtgtcaaaagaaaattggcttgctgattaagtattcaatgatggtacaagaataaagttagaattattttatatgcatacactttctcaggggacttattctttaatattatttgttaatgtttctttaaaaacactgaatggtttcatgggttgtgtatccaagaattgattggatgaggctgaatacttcatggaatgctcagaactttggtgaactgaagtttaattcatttccacaaccaagtgctaagttcttagtacatgcttagcactagtctgtgtttagggacaaaaccagcaaaaaaaaaaaatgaaaacaattttatacttttccttagagaatataaagtccactaagacaattgcgtatacatcgataatttttaatggaaaatgatggttaaatgagacttggttatactattatcgttaactctatatatgtttgaaaatgccataattaaacaatgaggggaagaaagtcttctgagagagataaaacatccacattggcagccttgtattttgtgtcattaaatgtccaaagagttgttagggtgcagaaaacaatctccaaaatgaagacctccgaagcagtttcagaaataaaagtttctctctgaccttctccttccttcctgtttctcacttctactcccccaaggctagccactgaaactacagttggcttccacaggaacctcttccccatggcagggcatagaaaccagaacctctctttttcttcaaagccagccataacacctaaaaacaactgctctaactttcccctgcctttctgtgaagtaactggccatgaagaaattatctgacctgtcttatttgcatgtaggtcaaaagacccgaatactagaaagggtcctgccctgtacccaggaggaagaaatgctgtacaaagtggccaagaagaatttgaacagacaggccttgctgggtttcttcacctcagtctactagcattaattagatcatactctttatgtgaaatcatatttctacatgggtgtccatacatcattgaacctaagcataaaaatggattttttgccatatctttgggtcttccttctgaaggttcctgtgtcgtctaaactatgatcaaataaatttgttatgtttttctcttgttaacctgtttttgtgataggagtgttggtcatgacccttaaatgggaaggaaaaggatcaaaatattagtactgtggagaaaatagtactaataaaggatctccaagaaggaagaaacacataggctctggggtccagtaaaagttgatctggtacttgagaggctgaggcaggaggatcgcttgaacccaggagttctaatccagcctgagcaacatagcaagaccctgtctcttaaaaaattgagctactatggtgggcatgaaaatggtgggtgtgtaaaggcaggagtaaaaggcacttgaggtttcccaattataaggcatagatagcagtctcaggtggtcagaaatgagaacgatcatactgtgtaaggggccagccatactgctctctctggcccacatggagggtcttgaaatgaggagggaagtagtatgttgaaaaagttgtaccttattgagaagtttccaaatccagggtgggagatttttctgtctgactcctcggtgcttggaccactcagaagaggctaatcagcagaacaatgtgatgacagtgatgatttttacaagtcaatcttatgactgaattcagcagatcaaaggggcccataacacagcatttactggacatccacacactgtacgattcaagccccatcggtctgaactagacctatgaagttgcgttgttcgcatttttagatgatgacctgtggaaagcaaggcatatttttgttacttagttccctttctcttgggtagagatttatttttttgttatgaaaggtaatcaggtttttggcttacaaactcatattttttaaaagtctattcaaatattcttttgtcaacagaattgctaaattttgttcatttaagtttgttctttctgctgggatcccgggggaactttcccttataataaaagctgaaggatgtccagattatgctcttctcctccatctgcctgttaagtccttaatctcctacacctgggtgttctaatcctttatttgctttaagtaccaagtggttccaagtcggacaagttctgtgtccaatatgccaagtaagattcattgtgccatagaagggcatgctactccccaagatctcctggagaataaagtgggttgctgttcacaaatggacctgctggttttaatgcagcccagttaataaatggcattcactcagcatacagccaagagtactccattgattggcagcaggaagctccttgttcatgttgagagttcctttttgcggtgccacttgcctctgagaattgtcagtgggctgccttcacagtgcagcaaaaggtcctttctgctttttcattgccatttgcttcccagtttggagccagttgagttatttagctatgggcctgagttgtgtaaggtacagcatttttaaatgagtttgtttttgtgtcttccttgttcggagttttttgtttgtttgtttttttggaaaaacatccagcaaaggatacggaaggcaacgttatcctgtgcttcttagttatcactatgctaactgaaattcagtggactacccttgtcaagaggttatgccgtatattgagtttcagccttgggtctcactctagttcagagagagctcatgttacagaaacaatcctctcacctcagccaataaatcctaacaaatcatctctacacccagtgagaccatgtatatctatcagctatcttatggagtgaccagaaatcagagagaaagaaggcacaatctacttcccctgttatccaagtaaaagcttagtcatctataactaacttaataaagcatgtgcttgttgggtaaagacagagtagctcactaagcttagaaaagaaagataagagaaaggctattcattgtctagtacctttgcatttctgattagcctgcatataagtggatggcattttttttgtaggcaccgagactggaactttccatattatttttcaatcttattacctctactagaaagacagtggataagggagattacttaaaccattttttgtgatcatattgttgggagggagtgaactggtaccagggagaattggaaattttctataaaaatggtgttaatttattagccatgagaaggagaaataaaaaaaatcagaatatcttaattcagagggaatggtttggaaaatatgaattagaatgacatttgtacttcttattacaagctggccacacaacattttttaattcttaagtttttttaaggttctctccttccataatataaaacaaagaggctgatgagaagttatttcagctgctgaggtaacagactttgacggcagtaactccagtgtggggaggtcagcaagctgctttatgtagcagctaccacacttcagcatagccattgccttgtgtagggtccgaacgttggttgcagaccaggactcctgcatctggtctgtaatgatttcctactctctagatgatctgaattgatttctgattactcctggactctaggctcccccacccctctctgccatcagctttgttccaggaagccccatttataccctaactttcacttcccactcctcttccaagaggaaccatgtccctattaggaaaagattttgtccttgcaccaggggttaagagaattgagagtaggagaggtgatgtctgtaccatgtcttttagttggtctcagtttttaaaaaggtctagtgaatgctcagttggattagactgtgtggtaagtgaaaaaagaatgaaaaatattaaatctttgaattaagaagttgttctctagcagggttgtaattgataacctattgacttgactgttgagtggtgagacatttaatatagagaatggcaaccctatcattttttagtgcccaagattataatattatttatttaaaagtgacatgtaaccttaacaatgatctgccttctcctgaatctttgattcttttctccaggcctactccggtgtacaccacgtgtccactgatgcctacctgtctctttgcaaatatgtaaaggtttcattcagctgcaaagcttggcgaaagtttatgaaacttaagaagaattgatgtacagaaggacagtgaaaaactttgccctgtctttctggacatatgttcttcatagctggacttcgtagggtggtttttacttaatgcctctagttcctttcaaattgtctcataacttgtaacttggttgctattcctttcatgcgtcgaaaattgctgtcttctgatgagatatctctgacttttcccaagtccttattcccgttgacttccatgtaatatttgagattattggactctccttccttccttagatataaaagcctatactatcctttattttttggtaaacttttttgatcgttttttcttttttcacctttttaaaaaaaattcctctaaatgcaagcagttcgtgtatttaattttcttttattaatatttatttttggtgaaatattttatacatgactaatcaggaaatataaataataataatatatgtatgttttatggaaatcgacttaatcttaccagtacttcctaaaagtttctctctattaatcactttccttctatcctaaggaatgtagtattttgaattttttgttcatcattttgtttcttttttctttaatttactttaaacaaatattttgttttatacagttaacaaatgttttataaatggtatcatgatttgtatattttttggctactcgatttttttttcccagtcaatatccaggtttatgtagtggtaatcatttttttcagtgttgtatagcattctatttttgaataagctgaaattgattattcagtcatttgtctatggatagttgggttgttttctggttttctagtggtaatatttttaaaaatgttgttatgagcattcatgtacatgtgtatgatattgctaagtagtgatattgctaagtcatgtggtttatgtattcaacttgttgactctaagctgttcaccaaaatgactgaacaattggcattccagctggcagtatgcatttctattgatgcatatgctgagtaacccttggtatttatttgcacattttcagattatttttcctattaggtaaagataatattgtggtccaaatttgaatttttctgactaccattgaggttgagcatgttttcaaatatctgatatttgtgtttctttccctttcatgttttcatttgtgtcttttgctcagttatctattggtttatctgtttcttatcaattgggaagccttcttttctggtctagatagtaatcatttgacaataatacatgcttgtcttggcttgggtttattttttcagtttcttatagttctttggacaaaaagccttaattttaatattgatttttttttgattttttttttttttactttacaaataaaaaaggaatgactttgttaagaagctcttcccagcactgaggttatttaattctatatttcttctaaaaattttatgatttgcctttccaatttaaatatttgatgactttgggtttgattttatatacagcataaagtaggatatttatgatactcttccttagtgctggattcatgcatatacatttttttctgtgtttttttctttgtttctctgtgtttgtcttgtatgtgtgtgtctatgtgtgtgtgtgtgtatgtatatatccatatatatatatatatatttttttttcttctgagctctgagccttctatctgcctgctagaaatttccatgttgatgtacatcaccttaaactaattatatctaaaatggaaccagtttctcacactttcttactccccctacatctaactggcatctagatcctttaaacatgtcctttgaaatgagtttttatctgatagtttttattcctactaccaccctatttcatgccatgtgacctgaacctcagacctccgaaatgtttcaagtatacctcttgaatttctgttttccccacacagatcatgtgcagctgacaccatattagtattaatttttctaaagtataaattttgattctcttaattttttttcttttgagacaaaatatcactctgttgcccaggctggaatgcagtgctgtggtcatagctcactgcagtctctaactcctgagctcaagtgatcctccctgcctcagcctcccgagtggctgggactacaggcacatgccaccacacccggctaatttttaaattttttttttcagagatgctgtctgcctatgttgaccaagctagccttgaactcctggcctcaagctactctggcttcaacctcctgaaatgttggggttacatgcatgagccaccataccttgccgattctctcgaatgaaagtaacattattaattcctctttgtcatagtaaagtggctggtccctaaggctctctctgtttcttgtctagccccagttctgttttataacatctgtcttctaacttagtttctctttaaattatcttgcatttttgttttcacttattagctcattccattgtatccattgctccactaactggcaaatagaaatccaatccattctatcattcttttggcattcatgattcactgagctataaccttcttgaatgtttttgttgaaataaaggtacagattcttatattttcctttattccctggtatggttaggctctgtgtcaccacccaattctcatcttgaatcgtaatccccataatctccatgtgccaagggcagaacaggtgaagataactgaatcatggggatggtttcccccacgctgttcttgtgatagtgagtgagttctcaggagatctgatggttttataagaggcttcccccttcactctgtcctgccaccctgtgaagaagatatctgcttcgcctttgccttctgccatgattgtaaattacccagtctcacgtatttcttcatagctgtgttagaacaaactaatgcattccctatagcatccatcataatagctagcatataacacataattaataaatactgagggattgattagtagaaggatactggtcttattctatgaaattgtatttgggttcttctgggtgaaattcttttaataacaattcatttgtgtagttaaagtttaaaggatgctattaattttattatggcaaaaatgaaacatttgagttttacttagaataattgacagaatctgtatttttctgaagatccaattttcaacctgcatggatagcctttctttcctaaattacttgttttttaaatgttaactataaatgtttcatttctatttgttttcttgatttcttttctttttgtgtgtttcttgactttctcagccagagaaaagtaatgctaccatagcaataatacatttagattctagtagacttgttttcttacatttctgttttatataaacaaggcgagtcatagtgaaagtacctagactaactattcaagcctgatatgtttatggactctttgtggaaaaaaggaaactttaaatcctctaagctactaaagatgtagaaggataatccagtattatttggtgattcatgtaaagaagaaaaataaaagaaggagaaaaatctggttgaagccacctctattagtcaactttatttcagatattaattagtctgcactaaaatgacagtgataagccaataaaatgatgactttgaaacgggaattcttcaaaaatctagtaaaaagagtatcgactctttcttgtcttctttttcaaacttactgtttagctcatctttatagcattcaagaaaagaatacttgagtagaataaagagctatttttatcttcagaaaaaaaattatttaagaaatatggaagtaacaaaataggcatgccagagaactgccatttgccactgctttttgagcagcacggtggtatatgatccatttcttaaactgccatggtgagttagagtgccttgtttctcacaagttttgttttattaaaaaaatagtttcttgtcttcttctctcttctaggttttatcagtttgttaactgtcttcctagctggactagggagcatgtgctgattgtatgtgaaaatgaactccttgggaatttagcgttctactgaattctcttgaacaaataaatctggagatgcttttctttgtgcaaagttgcatttctttaaacaggtaatcatcgttattaaacttagcaattggtagagttatatatgttttaatttcaagggctttaatgattattttctctaacaaccagattttagagactcataagaagccacttgatttgcacatatcacacacagaaagggttcttagtgagcctttccattcaactactttcaaaaaaacttaaatgttttatgcattttacaaataactttttctcttaaagtccaaccaaaggggtgttttgtgtatttttatcctttacatccattgaaattacctgttctgtatgatataatgaaacatgggtacttatttaagctaaaatatagttgctaaagttgggcctccctgatgttaaatgctacccccttcagtagtgacattaattaaagaaaacttgttaatttgtgagttattctaaaatactttctctcataaagaagctatgtttctccttctaactagtatacttaggttttgcttggcaagactatgtggaaagaggtcttatgtcaccccagcttagcagtgaagagcagaaggcactactgtgcctctcttggtctttttaggtaaaccacaggcaaaatatggagcacatttcagaataatgttaatgctccaaaattgcataagtcctgggctccaaaattgcataagtcgtggggctgtgacacaaccatcttccatgattgtgtttcagtctgactgcagtgttgcttttgtcttcgtagggtaaactctgttgtttcaacaggtatctagacttcaaataattgttaaatgagtgttgtaattgaaataatcagcccttggaactgcaatcattatgaaaattgtatgctctttaaattctatgtaaaaatagattgttttaaagaaaaaaaattcattttaaaaacagaaatgtgcttgaacaacttattttaatggaataaagttaagcaacgaatcttcattccacagctttaacaagtcttccagcttaaggtaatcaactacagcagatattattttaagatattgaggtagcaaagagtcctatctacttagagaatgtatgatttataatagaataccatgcactaatattgaacagcatcaacccatatgaaatcattttattacaaatataacctaggcagtagcatggaagagaactgatgagaaatatagtaggagtaatacactaacggatatgatctccaaatgtttattctctgtcttacttctcacctatggggccgctttcactccctaagggcttctcatagactgacaaagacctcagctccttaatgcaatgccagtaatacggattcataggaaaacttcccagtgaatctagggggtagagtttagtggaacaaaaaagggcgaccagctttggaagctgtagttaggaatggggagacaataggcagaactggagttagcctgcagatttagcgactgtaggtcagagatggggatgcaaaacctgaaatactggtgatgcagattgagtgaagtcagttgatttcagaaatgccttggagatgtaactgataggagtagaaggttattggcatgtgagtttagggaaggaaggcggacatgttgcctggttttctaattgtacaagcgtagtgaatcgtgatgccattttttgatacataagttatttgagaggaggcagattatgagtgtgtatgttttgtgtttgtgtgtgtgtgtatgtgtacactgtgagttgtggggttgaagatgctggtttaggtgactgtgggccagccatgtgccattggctcaaagtttgaatatttaagggttaggagaaagatcctaactaaggagccgttagcataaagatactgacagaagtgagaaggagctaagctagtattgccctggaagaataaacagagtatgaaaagggttcatgaataccaacatttatgatagtctatagaagagccagaaaattgagcctgcaaaaggggccagagaagcaacatataacgagttaagtacaaaccacaatattgagtaacaggaaatttaaaggaagagaatgtttcaagaaaggaacaggtaagactgacaaatcttacagaaatctcaaagaagttaaaatttaaaagatttattgactttagcctagaagactggttttaacttcttccaaatgcatgttttgagtaaataaacagagcaatggaagtatggatagttctgacgcacatgatattctgtttctttcctggcttttttttttttttttttttttttttggaattgagtcttcctctgtcgcccaggctggagtgcagtggtgcgatcttggctcactgcaagctccgcctcctgggttcacaccattcttatgccgcagcctccctagtagctgggactacaggcgcccgccaccacacccagctaattttgtttttgtatttttagtagagacggggtttcaccatgttaggcaggatggtctccatctcctgacctcgtgatccgcccaccccggcctcccaaagtgttgagattacaggcgtgagccacctcacccggcccgtttcctggctttttatgaaaatgatgtgttcttctggtttgtctttggttagcttttttgtttctttatttgtaatttagtctcgggaacttaagataaagttatctgtattatctgctattcttaacagaaggccaatttttgaatgtgctacaaaataatctacctaaagcaggcaagacaatataaatcattttatttttgcttatatagatccagaacataaatccctgagataatatcctcatcctaaaaggaagagtaaagtaatatagccttccagcttggaagaaaggcagtctagttatcaaataatatatgatcaatgatgatctccaactctaaagtaaactcaaacagtgtgtatattcagatgaattaaaaccatatattcatttagtatatgtgataagtagatgtgcatttatagaattactttcttctgaaaaggcaaaaagactctttttataatgtaaataaattaatgttattttaaaaatgaagatactatatgcctgaagttttaatgtacttttaaaaattggatcagagtgtgaaatcaaatgttagtgattaatattattattattatcgtaactaataatattaatgcatgtgcttaacagttctctcagcttcttaaatgttaaattttaaagcaaataacaagtacaatgcaaaatttaccaacacaccaatgtgatacatacttttacctattatttttttttaaaagagagtattgaaaaattatcattttggtttaagcatttgagcaaacaaaataaaatttctgattttaagatttaaaataatgtatgagtaaaaacattattttgggaaaaatgaattgtattaaaagaaatgctgaaattttttacagttggacaaattgctatatttttgtggctttattaaaaatagaaatagtgatatccaccctccattaggggaaacattcacttgtttattcaagaaatatttttcaagtgtcttcttcatgccaggcactattttcagtacttaaaatgtaacaatgggtcaaagaaacaagtcttgactctgaaaaagctctcctgttggggaaggtggttacaaacaatgaacagctaacattataagtaagactagatggtagtacagttatgggaaagaagatagagcagtgtggtgggggtggggtgtgtatgttgaaatctgggaggtaaggacatattgtaattttttttaaattttattttattattatactttaagttttagggtacatgtgcacaatgtgcaggttagttacatatgtatacatgtgccatgctggtgtgctgcacccattaacttgtcatttagcattagttatatctcctaaagctatccgtcccccctccccccaccccacaacagtccccatactgtgatgttccccttcctgtgtccgtgtgttctcattgttcagttcccacctatgagtgagaatatgcagtgtttggttttttgttcttgcgatagtttactgagaatgatgatttccaatttcatccatgtccctacaaaggacatgaactcatcattttttatggctgcatagtatatgtgccacattttcttaatccagtctatcattgttggacatttgggttggatccaagtctttgctattgtgaataatgccgcaataaacatacgtgtgtatgtgtctttatagcagcatgatttatagtcctttgggtatatacccagtaatgggatggctgggtcaaatggtatttctagttctagatccctgaggaatccccccactgacttccacaggggttgaactagtttacagtcccaccaagagtgtaaaagtgttcgtacttctccatatcctctccagcacctgttgtttcctgattttttaatgattgccattctaactggtgtgagatggtatctcattgtggttttgatttgcattcctctgttggcccgtgatggtgagcattttttcacgtgtttttggctgcataaatgtcttcttttgagaagtgtctgttcatgtcctttgcccactttttgttggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaggctctttagtttaattagatcccatttgtcaattttgggttttgttgccattgcttttggtgttttagacatgaagtcctttcccatgcctatgtcctgaatggtaatgcctaggttttcttctggggtttttatggttttaggtctaacgtttaagtctttaatccatcttgaattaatgtttgtataaggtgtaaggaagggatccagtttcagctttctacataaggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcagtgcgggctcttttttgattccatatgaactttaaagtagttttttccaattctgtgaagaaagtcattggtagcttgatgggggatggcattgaatctataaattaccttgggcagtatggccattttcatgatattgattcttcctacccatgagcatggaatgttcttccatttgtttgtatcctcttttatttccttgagcagtggtttgtagttctccttgaagatatccttcacgtcccttgtaagttggattcctaggtattttattctctttgaagcaattgtgattgggagttcactcatgatttggctctctgtttgtctgttattggtgtataagaatgcttgtgatttttgcacattgattttgtatcctgagacttcgctgaagttgcttatcagcttgaggagattttgggctgagacagtggggttttctaggtatacaatcatgtcgtctgcaaacagggacaatttgacttcctcttttcctaattgaataccctttatttccttctcctgcctaattgccctgaccagaacttccaacactatgttgaataggagtggtgagagagggcatccctgtcttgtgccagttttcaaaggaaatgcttccagtttttgcccattcagtatgatattggctgtgggtttgtcatagatagctcttattattttgagatacgtcccatcaatacctaatttattgagagtttttagcatgaagggttattgaattttgtcaacggccttttctgcatctattgagataatcatgtggtttttgtcttttgttctgtttatatgctggattacatttattgatttgtgtatattgaaccagccttgcatcccagggatgaagcccacttgatcatagtggataagctttttgatgtgctgctggattcggtttgccagtattttattgaggatttttgcatcaatgttcatcaaggatattggtcttttttggttgtgtctctgcccggctttggtatcaggatgatgctggcctcataaaatgagctacagaggattccctctttttctattgattggaatagtttcagaaggaatggtaccagttcctccttgtacctttggtagaattcggctgtgaatccatctggtcctggactctttttggttggtaagctattgattattgccacaatttcagagcctgttattggtctattcagagagtcaacttcttcctgttttagtctttggagagtgtgtgtcaaggaatttatacgtttcttctagattttctagtttatttgcttagaggtgtttgtagtattctctgatggtagtttgtatttctgtgggatcgataaagaggtgatatcccctttatcattttttattgcatctatatgattcttctctcttttcttctttatttgtcttgctagcagtctatcaattttgttgatcctttcaaaaaaccagctcctggattcattaattttttgaagggctttttatgtctctacttccttcagttctgctctgattttagttatttcttgccttccgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgctgtgtctttgttctcattggtttcaaagaacatctttatttctgccttcattttgttatgtacccagtagtcattcaggagcaggttgttcagtttccatgtagttgagcgattttaagtgagtttcttaatgctgagttctagtttgattgcactgtggtctgagagacagtttgttataatttctgatcttttacatttgctgaggagagctttacttccaactatgtggtcaattttggaatagatgtggtgtggtgctgaaaaaaatgtatattctgttgatttggggtggagagatctgtagatgtctgttaggtctgcctagtgcagagctgagttcaattcctgggtatccttgttaactttccgtctcattgatctgtctaatgttgacagtggggtgttaaagtctcccattattattgtgtgggagtctaagtctctttgtaggtcactcaggacttgctttatgaatctgggtgctcctgtgttgggtgcatatatatttaggatagttagctcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccgatttgccagtctgtgtcttttaattggagcatttagtccatttacatttaaagttaatattgttatgtgtgaatttgatcctgtcattatgatattagctggttattttgctcgttagttgatatagtttcttcctagcctcgatggtctttacaatttggcatgattttgcagtggctggtaccggttgttcctttccatgtttagggcttccttcaggagctcttttagggcaggcctggtggtgacaaaatctctcagcatttgcttgtctgtaaagtattttatttctccttcacttatgaagcttagtttggctgaatatgaaattctgggttgaaaattcttttctttaagaatgttgaatattggcccccactctcttctggcttgtagagtttctgccaagagatccgctgttagtctgatgggcttccctttgtggataacccaacctttctctatggctgcccttaacattttttccttcatttcaactttggtgaatctgacaattatgtgtcttggagttgctcttctcgaggagtatctttgtggcattctctgtgtttcctgaatctgaatgttggcctgccttgctaggttggaattgagtagtctgagtgggcttcattgagttgatttttgagcaaagatgtgaagaagacgagggtatattctgaataggtatctactagaagagccagggtaaaggccctgtggtggaagcatgcctgtccatgggttgcaaggagtcactgtggctagatggcagtgagcaagaaggggagaggagaaagaggagaaggaggttaagacagggagggaattgagtcaggtcactttagaaacttgttttgcttcgaaggacttgcccttgactcagaggccatggagagtcattggaagcttttgagtagagaaacttgctaggaacttgatttcagtgatgttaatcgttttttatgttctttagagcacactctgtaaggatgtaagtctaaacttttcttttttagccttttcaacagtaagctatacataaaagttacagtgtagcctactggccatgaatagaagtgctatgtgactttatggtgtcctgaagtttaaggtatattagctctgcatatgtcctgtttccagaatcttaaaaatttaattttggagaatcaagctttgtttaaaataatcaccttaatatgtagatgtggaaaactaacttgcttaagtttattgaaccggatttaccagagctagaattagggtttaggtctcctgactataaatgagaatgagaagcaagaaccaaaaagtatcaactgtgatcagatttgtattcggcactttacttattttgtaccaagctaggctcagtttcccccacttaaatgacattgctgcatcttttacacatttctttgaccaggtgttagtagatcattgcttttactacttagtgttactttttaattagtatgtaaaaaaatccatcctccttttcctccttagcaccaatttaaaaaaaaatcttgctttgtactcacttgagaaatacttgcaatccattaccagcctatggtttttccgtatcctgtaacagaggttggcaaattaccaccagcaggccaaatctgtcttgtggcttgtttgtgtccactatccaatagtggtttttacacttttaagtggttggaagggtagaaaagagaagaatcatactttatgacctgttaaaattattttaaagttgaaggacaatagtttgaaagtattcatatgttgacacatagtttattgcatagtttgtatttcaaatgtaaattaatcatatagttaaattttgaaagagaatcacatattactgacttaaggacttccaaactgtataatggaatcacatgtacaattatgtatctgtttatgtggaaacagataaacatatctgtttcatactgtaattctaaccatatgtctttcttaattactctttgttcctcaaagtctatggtttctttttgagttggtcagccctctgttctttactcatatttacaaacttatcattatgtctacattcataagttatttaataaaacttatttgaatttatgataaagcagaagtagaatgtatattatacacatattatggaaactttgcacttagcatgccttaagtggataaaaaagcaaaaattggcttcttagccaatgtgaaatttaggtaaatcttaaacttttgttttttactgcagatatatttttaattactatcagatataccctctgtctaccaaaatgatagagatgaaatgcaataaactttgtatcttttcccaaaactgtaatgtggtaaattaacttaataaaaatttagtatgaaaaatgcaagtaaacatttccagacttcactaattgtaaatggaaacaagatgctagagtctgtgaaacccaagaggactctaaagaagaccagcttggtaattcaagtaacagaagagaaatagatatgaaacagcatttctacttcagggtacactggagaaagaaaaaagaaggactcctttatgcatcattccaagagaaatagggagaaaaaaactgtgtttgaaggaaaggctgtgatttaatcaataatggacaccttagaaagactgattcttagcaccagggttaggaataataaaataatctgctcatagaaggcacagcaaacattgatttcttctttttaagaatatttgtttatatgatcaaatttactaaaataaaccgttaattacagtgtacatttaaataatgtacttagtttactaatgtatcaaacataaacatttttaattgtccttgtggaaaaatatgtaatatgatggagatggggaagtataaaaaaagcaaagattaaaagaaaaaagaatcatctacagctataagcacaaaggctccatcacagggatatcaagcatgtttcccttagattctgtcatatgcgttactgtctgcttgagtccatctgatcacaatgtatgcacaaggaaacatgtctatgatatgatcgtgtgtctcttttgtgctttttgcacctgaattgtctgtactagagaattgcaaaacaagtttgaaatgaattgtacctcttttcctcagttagttttattgttattgttatttaattgtagtaaacctaagagcctgtaattcagataattcctggaaaagtattttgatcaggcatattggtttggaataggtctgagctttgcattctctaaaattttattacatgctttacttcttccatgagatactggtaagtgatgtttggtatttctgataaggtcttagaaatcccagtccaattaaataataagggagtaaaggtttatggaggtctgcagtagaggatcactattgctatggtttgaatgtatcctctattaagagggaggacttttaagagatgattaagtcatgagggcacctgcctacacaaatgggtttaaagcccttataaaaggtgttggcttgtggggttttgttttgttttgttttgccactcaccatgtgaaaacacagcatttctcctctctgaggatgcagcaacaagtcaccatcttggaagcagagagcagccttcaccagacaaccaaacctgctagtgccttgattttggacttcgcagcttctagaactgtgagaaataaatttgttttaaattacccagtctctggtattttgttatagcagcataaagtgaactatgacaaaacaatggctacctccacttattctatactgatatatttattgcattatatactttgactttcataataattgtatgaagtgaaatatgttcattttataaagaaaaaaactaaaagcctgggtgaaactttcttaaccagggtcacaaagctaatacacaccagttggctgttgaaccccaaaccatttcactatttggctattctttgaccaccaagacacttttctttctttaacaaaggttattgatggtctgtttgcaagataggcattcatttaggtgttggaataaaaatataaattacccacagctgttgcgcttgtctagcttctgtcttgtatggggtgaaaataattataagtaattagtcaataaataattacattaaaattcaaatactataatggatatatgtcaatgtactagttaacacagagtaggattatctattacctgagactggcaaagaaagaattcataggacggatgccctatgaactgcatcctatttttaggaaaagaggaggaaggtcatgacagagaaaataacacatataaatccaccgagttgtgaaagaaatgttctgggagttatatttctttgtgtctgatgcctggggaaaataaatctaaaataatatctgaaatagaaaccagtatttccaaagggaaaatacattatgctctaatttattcacatattaatttttagttttgataaaattgcaattagaatagcaatgggattgttatttaatatattttaaaaatattcatctaggtcagtattcttcaaagtctttttaaaaaatgcatttggacttttctaaataaatactatgagaagatttatgtttacaatatatggcataatttccatgagaaatatgtggaatacaatcaggaagtcagcaatacagaattatctaaaacttattcatgtaagttttactgatatttgttttatttttctatgagcaaaataatttttctttgggtatcctcaattgctttttacaagtccatgtgatatatagtaatctatcttattgatacctacggatttatttaattaaaatagttttttattggtagctgatgataccttctgcaaagaatgccatatttatcttttcatttctaacagtggcatattttatttctctttcatgatatattgcattagcgtgaacttctaaaactgtaggtttttcttcaattggttaaaggagttaaaagttgtggtgagagaactttgccctttttctacaacaagagtagttaaaaacaaatgcctaccagggccacactgtagcataaatatgtgaacagggatgactgtaagaacacagaaaatggcagagcaagagaaattgagaatgtattgtgttaaaacaccatgccaaacaaacacaacataagtttgcatatgcaagcttgatgcaggtaaaggactgatggaggtgatcccagttgagaaagggtatagtactcctgaagagattgctcattataaccacagcagtgggagaaatatcactgtgctgtaagagctgctaaattatttggtatcaatgggtattgattgcaaaacaacatggaccaatgaaagtacagggattttgaatctgagttcaaattataactcagttccttactagtattgtgatcttggacacgtaacttatagtattagttttctaatttatcccataacaaattgccaaaaacttagtggcttaaaattacatttataatcttacagttctaggtcagtagcctgacatgggtctcattggtctaaaatcaaggtgttggcaggaatgtgttcccttttagaggctccaggaaagaatcttggcttttgtagcctcagaaggccatctacccaccttccttagcttatggccccttctgtcttcaagaccagcgacagcagggttgagcccttctcccattgaatccctctgacctcttctgtagctacattgcttcggagtcttatttttctcttttacttttaaagactcttatgattacattgaacccacctgggtaatccaaggttaatgtcacatttcaaggtcacctgactggtaaccttaattcctccttgccatgtaacagcattcccacattctggagattcatatgtaggcatttttcaagaagccattttgtctactacattatcttttaatttctttccttatttataaaatgagactgttctgaagattaacagcaaaaaaaagataaagtatattaaatgccttgtttaataccaggcatatagtcagaattcaataagtgttatctgatgttgtttcctgcattgcttttcctattacacccttagtttttggcttatagttatcctctatttttaaaatcaatcttcagatatttttcaatgattaagagtttcattcagtatgttgcttttacactgataaacatacagggtataagtttaaataagcttaaaaaattaaattgctaatgtgtagaatcctttaaagcagctccagttctctatcctagagaactggcccctgttcccctaatctctacaccagggtttcccaagcctgaggaggtattctgatgaatgcctggagtacttggtaaactgaaatctctgagccccataccaaggatttctgacacggtaggactggggaaagacctgagaatttgcatttttaacaagtcatcagtgtatgtcatcagtggatactgatggctttggtctgtgaccacagtttgagaaccagtgctatagaaataatggggttaatttggctttcttcacatgtgcagttaagcatatctttgtgggtttttttggatgctagctctccaaatactgacaaagtctgcttagtggtagaaaatgtcagttttaagtggtaatgcgtaaacatttttctttatcccagaatgcaaatctaccctcaaaagcactgttatttgaagtgaagcaaattgtaaccatagagtagatatcaaaacttgtgtgcctttctaaccaaagaagcgcatctgaacaagattcatagggagattttggttgtttcccatctttgttcagtcagtttagctggctatttttcagttttgaaaattgtaaaaatggaatggttttccatctgattgtgttactgcttcacaaatcaagtgtcttttaataatactgtcctgaagttactaaatgtagtgccattttttgccacatgacatttatgcagtgcaaagatacttcattattatataaggcatgaaaaacaaagtgttaaattaataatattgtttgacacatccttgaaattgtccttgaattatggtagtatgaaatacctaacaatttgcatcatgtttaaactcagattgctttgatataggaatctagaataagtttctgaaacttatttcatctccataaagtatattacggtggcaaaggtcaaattttctgtatttatctatgtgttaagaggctaagactttaaaaggaggaaaaagagcctagagatgtctcactaaaaccttcaaatatgttatttaaaaggtatcccacaggatcaattgctctttattaaaaatatgattttttaaagaggtttaatgtcattgcattgattgaacaacaatagagaatcaaatacattgttaaagaaatttgacctttaggtcatttaaactgtaagtcagacattctatttcaatactttgaactaagactgtacttagattttataaatttgatttgtggctcattttcttgaagaatagcacatataacaaattgtatttggtgtagtgttaataatgattgaaatcttagtaagacaatataattggacatttctggaccctgaaacagacactgcttctaaaactttgctgtgaacaagaatttcaagtccattctagtggtttataatgtcagagtctttaagaatcacctggtatgcttttcaaacatgcaggtccaagggccctaccactcagaaatgatgactttccatatctttagtagaacttagaaatgttaatttataatatatattttagatgggtctaatgcaagtagttcagagacaccacttcaagaagcactggtgcacgctgtagccatagtgaccatagatttggtggaagtaagaatggattgctgaacatgggattcagatggaaaatggaagaaagccaatgcagtaataagaaagaagaaaggtcaggagcttgaggaaacaattataccaagagaaggtatttcatacttttaaatttaaaagtgctaaagtggtatttgctaatttttaaggaattctcagttttcaaagctaggttccactaaattatataacatatacttaatgttaactgactatagagtgtgaagggggagagtatttcaagcatatgaggatgaataaacagttttttcctaaaagtatttgtaatttaatatagtaggtttcaaatgttcttgtttcatcatttttatttgaggggtatcttacttgtaattctaacatcaaaagcagaaccagatgtctaaaatctttggtttgatttctaacagagctgaatcccatgcccttttatcctctgtttcatgtattccacactcttctaaagtagagcattcttaaagcatcactatggaaattctaggattcttcagcacacaaattgaaaatgattattttagaaagttctcaatacaaaattgagtatgcagatagagatattttcacatgaaatggggaaataatctagattcacttttgtattattatatccaaagcgtatagatgtagacttcaaaaaaatctgtgaattaactgatataaaatttagtatttaatgtgctgaaagccatgtgtgtatgacaagaaacgaatcttggatagcatccatatttatgaaagaaatacaaagaacccccaaaatgagaacagccaacgagtatacagtgaaataactttcagttttgtgaaagctagtgtagtcaagtgtcaagaagcaagctatcacagagccagaaatctgaagaataatctttgtatttaattatacagtctgcttcaatgagaaagcctccagtagagatttgagtgaagaagccatatctcagtgggaagacaagttagttggagatgataaaaaatagaaagtaggtagggagtagaaaattggataagaagagaatgtttggacagtagccacaggataatcatgatcagaaggctttttaaaaaatgaaagaaactacttgagcatatttataaaaggctaatggaaaggagtaaatagaaaggggatgttaaagatacagaagaaattgatgacagacggaatgagatccaggaaaagcaaatagtcaaatgcttagagttggccctgaacagctaacgtcagctcatcttccaagaatgacggaaaggaagtaacaatagagaggatgcacagaggtttttagcttggtgacaagaagttaagggcaatggtgtctagttttgatgatttgtcttgataaagtttgaaaccaaaaagtggctatactgtggtttgtgatgttgaatttacaggtaagaggaacttagatgatcaactgtgaggttgaaggtagataaaagtttggaagtccctctgaggtgaaagagcagacagtgaaaggaggttttggattatcatcacgcttgggagaaactctgcttttgctcatgaaagatttgctcatgaaaatgtggaatacatgaaacagaggataaaagggcatgggattcagctctgttagaaagataaccactgcagttgtctttctgagcaagagttttcggacatggtcttcagggaagacagtactgctattcctgatagatgagaaacaaatgaggtgccccctacgttcatcccaattcacagcctcttggtagtatctgggcctggcagagggagaggaacctaaataggatctagcactttcacttgatgggaggagactgagatcagagctggggaagctgaggcagtgagacattgtagggcaaggaactggagagaaagaagatgcacagaaagaaacacctccagagattaacagagggatcatttcaaattggaatatatatcaggtaaaactttaagaggcaggatagaaatccactgaaaagcagtaggacaaaaaaattctcaaaattcacccagatctgggaactagttggcactcccatcagccaggctagaaaaccttcataatacacaaagtattggatagagtgttcaaaaagatactgccttattagtgggactaaattggctttactctgaaggctacactaacaaagctttaaattaatctttgtgagaattagattaatttacacataacagtgtgcacccctcaaaagcttgatattctttaaaggaatacaacaatatccagcatcaaacaatataaaatctgcgtgcaaagaagcagaataacatgaactgtagctagtggtgggaaacaatccatggaaacatacctgcaaaaggtagagatgaccggactagcaaagatgttaaacagctattaaaaatatgtgctgtgtgctcaagagagaggaaaatatgaacataataaggagagaaatggaaggtacacaaatgaaccaaatggaacttctagagatagttcctatacaaatcatagcaatagaaattattgaaaatgaaacacaaacagaaaaaaatgtgaaaaaagattaatataagctcagtgcactgtggggcagtatcaagtagtctgacatgtaattgggtttcacagcaaaagagaaggagaacaaaaatatttggaaaagtaatggccaaatattttctaaatttgatgaaaactataaacgcacagttcgaagagcacaatgaaccccaagcagagtaaatgtaaagaaaacaacaccatgacgtcacctagtagagtggctgaatactggtgttaggagaaaattttaaaagcagttagagaaaaaagacaggatcaccactggctgctgtggggagggtgcataatagaggcagggcaagagcccagtctttaccctgggtttggttacagagacaacagcttttaaaagtaggtgattctgggtcccgtacagaaagggatttaacaacagtaggatcttccagagggctcgtggatcacggttcgaacaaggcaggggaaggagtcataagattaagtagaactttctggtgcccaggattaaggattgaggtcataaagaatgacctcaatatttctaactttcctatgacatttctttcttatttatttatttatttattttggagacttttttttgagacagcgtattactctgttgcccaggcaacagtgcagtgtcacaatctaggctcattgcaagcctcccgggttcaaggaattctcctgtctcagcctcccaagcagctgggacggcaggcacacgccaccatgctcagctaatttttgtatttttagtaaagatggagtttcaccaagccaggctggtctccacctcctgaccttgtgatccacctgccttggcctcccaaagtgctgggattacaggcatgagccaccacgcccagcctttttttttttttttagacagagtcttgctctgtcacccagactggagtgcagtggtgcaatctcagctcactgcaacctaaacctcccaggttcaagcgattcttctgtctcagcctccaaagtagctgggattacaagcacccgtgaccgtgcctggctaatttttgtatttttagtagagacagggtttcaccatgttggccaggctggtctcaaactcctgacctcaggtgacccgcctgccttggcctcccaaagtgctggaattacaggcgcaagccaccacgcctggcctcctatgacatttcgatataactggctcagattctcagatcatgaccagcgtggcctgagaacattagaatttgctacaacatttgcaaagggatggcaaaagtcagtttttatctgtttttgtgtaatttgggtaagaagacaacagtattcctcttagtatattgtgtatgtataggagagtattggtatgtaaactgagaaataataaggtctccatttgtttcattcaactttatattctttttgtgtaacacaatgctagcccataacttgagacttaaggtatttaatgaacttctgtatactcagttttaattggtggcagttctttaataccagaaacaaattaaagtttttaaagttgacaacagaccccacatacttcccagtcaagcatagtaagaatgacatgaagttttattaagtaattgtatagtagagccctacagaaatttgcactctagtttccttagctttacagggaaggtgacgcttctgacctactttgtatgcattatgaacattaattataaaacatcatgtactttaaaaaatgtcctataaatgcatcttttctgtaaatatcatgcagattttaaaaaggaggtcatcttgtttttgtcttccaaactccagtgaaacagagaataacctttaggagttttgctgcaaagtagaaacattcattcttgcattggacacttttcattgagtgaacatttgaagcagggtaccacatgagatcgagttgtagaagagagaatttctgtcctctcagaacaaacacacatgggtcagtatctataaacaaatcagtatgtgaaaagtatcatgtgattagtccaggatatgtgccctgattgtgaagggtggctgggggccagggtgctgagcatggaggtggaaatcaaatctacataatgtggaaaagatgaccaggatgaaaggcatttgaattgttagtacttaccctggtgacagcaggagagagacatcatagtcacaggcattggcatttaaaaggtgctttgggaattgagagatgggcattttctgtgaattacagaagtccaaattgagtaggagttgggctttgttttggaacagaaattgagaacataagaggctgaatggagccagactgtgaagagctgtgaatgccagcctaataagtttgagctgtatccagtttttgaaaaagagagagagaaacagagagaacctcaaattttaacctgcaataaataccttcagagtcttgcttcagggaaatttaattttttgccatatgtaggccacatggagtcaggcagacttgttagtgggtcattgtggtagtctaggtatagtgagctaatggcctaaaagtgaaatacaatgcaaaagaaaaatgaagaatagataccagaaagattcttaggaactggtgataacatactacaaattgagtggatctttggctaaattgctgctttgtggctcctttcaagggcagtttatttctaactactaaacctattttcttaatataataaatgctcttgattttaattttagtatgaatatgtgcattgcttctatttatattatttttcggtctgtatacttgtatctgaaaatgatagtttaggaatggtcatattttatagattgggccattgaaaattatttaatttaccagacaatgtttaggaatttatagtgttaatgacttacatataaaagttcatgctttctaaaaagccctctctttcccccagcattattacttctgagatatgagaaggaagaattaccttacatttggctttataactgagaaattcttctcatacatcaaaaatgtactaattgtattttgagctctcctaaatcacttttgctccttggtttatatatatttctgagtcttgtttgttgactagaatggactctatttcagagcttctgctttttgtttctgtgtcaccttgtcattttctaaattgattggggcacccttgggggaagtggtctgtgaaggacaagtgtgcaccaaggactctgtaggcagggcaggaaaggagtgagccttgggggcgagcacaagtcaaacacaagctgggttcttcctgtcctcaccttcctggagaaatcaggacactttgctgcgggaaagcatgacctgttttaaccctttgtggtgggggtgttttgttgcaatactgctgtgggaaggcaccaccctttcttgttttccacataggactcatatattcatattttttatacttattctgccctctaatctctttctgcagccatctcattcattttcatcccaactaccattccgttttgtacacttatagctatattattgcctctttatctcacaagttgtggtatgataaataagtgatgtttgtacactgtttttgcaaaaaagctcacagtgctttctgggggtatctactaattaatctttacagaatccctatgagatagatagggctggatagggtattcagcacacaattcactagaccatgctgtctctctattatgataaaggattattattatgttaaaatgtttatacactgaatacataaatttgtagagattgatgtaaaccgaatcccttggcaaaaatatgaacatgcctgtagcataaaattgcaattgtgaagcaggttttatcaacttctggtgtttaaagaattattccagatttgcacattaaacctctgttggatagcttgttttcgttatcttgcctcttggggaatgacagggagcagtgagctactgaacttctgggatttcagcaagtgacaaactcagattcttgatagcgttatttaaaaagtatagcaagctcctctggcttgtgtgtgactcatctacatgtatataatagcttgattgacttatataattagtacttttatgtttatatactgataatatttgtggaaatctagtcaggtattttatgcttttgcagagtttgatgtggattagctgcattgccttttctacaaaagcaaacaccctgaagagttgtctcctttagggagggagcttcactcttttcagtcaacagccatgtatagtcctaagatgctttagtagtgtttcccccaccgtagcatatggattcactggggaaaaacacaaataaaccaggcagcagaaaagaaaagctagagaatcagttctttgctaatcttatgctatcacttccttctttttttttctctcaatgagtccatgttgcttttctctctttaccttccctttaatttcttttagctgttgaacatgtcaaaaactgcagctgctcatgaactcctatttcagctaaatacgtaaagatagattaattctgatagggattcatggaagttgaaagaaacttgagtttgtgtataagtatatggccactggcttgcacctctctgccttctattaggattccaagagagagggatgtagagtgggtttggaattggtgggatggtaagtgcagagatagggggttttaattcctaggcacagggggctccaggaagataggaagttctctaatcaccgaggtacagttctgcttccagggaaggatttatggaaagtaacaaaatatgtatacagtccctgattctagactactgagtgccaggcataggggtgttcttggaggtttctaagacagagaatagggtgataaaagtgaaacaatgggaaaactaacttatcaacttaaactccctggttggctcctgaactctcttccttcagcctttgcccctttcacattcatttggaggaatatttgaggggagaaaaaggagtgcgggaaggataattatattcttcctaaaatatgcgtaagatacagatcatttttggataagtgaaacctaaaaattgttttctttaccattagaccctaaagctcaatcagcacctcctgccttcgctttatttggagaagtccacatctggctggccctgttctcagatactggccttgcctgcttggtcttggcctgccctttgattcctgacctgctctgcagggttcagcagagtggatcatgttacaggggtcagcaggatatcaaactgcctttctgtactgatgtagagaaatagttactgctttgtgctataatatgacccaatgtttgcaaatacagatttctttctcttctataatcttcttaaagggtcaaaataagaaatcactatcacctagatttttttttcctaaaaagtttgattcgattaactgggaagttatttttttaaaaataattactcaaagaatatgctacaaaaagtataaaaatagactttaaaaatattcgaagtcccaaacatctaacataactacaattaatttattagcattttccagatttttctaaatatatgtttcacatactgtgtgtgctctaacatattctgtttgaaaatttaaatgttttaattgaatatgttttcccactttattttgatattgtttttgtgaacataattttcaaagcctggaacatatgcttaagaaattattatagttgaccaagttattctcctaatgattccatactttttctcttaaattttatatatatctttaaaaacacattttatattatttccataaacttaatttcccaaaggtgccttttgaacacagaaagtatggccaatgggctgtattgttaagttgctttctgaaagcatcatgcaagttacctttgaagcttctgtgttattagataatagtattttctttgataaactttcctgataggatagtcacaaggaggagaaggatagtgataattttcttgctactgagatcatataggaacagtattttaaaatgtattcactgacattgagaagctactaggagctcattattgtgttaagtgccagcctcccagggatgagtatgcagaactctgtccctaactttacaggtcctgaggagagtctggcgtaggatacctggttaccaagaagcttgatgagtgctgtcctggagttttgagttgagagctggaggaggagatattaagtttgataaggaaatagagtagtttaactcaagctgtgttttcagatttaggagatggggaagaggttaattttgtttctgttgatattattcatacatgcatgaatttaaaaaattgatgctaataaaggaaaacatcaaaaacccttaacacaattcatatacacacatgcatgtccaatgggtctgttctagtaagtcagtgattaacaaagactttactgcctgatgataggcttttccaggctgatggcaactattatttataaatatgctgtcattgagatgggaaatggcttgggatggaatgtgaggagttgttaataataagggcgttagctgtgatccacgaatactttcttccactcagtacattaaaattttggaggtaaacatgtagcaaaaattgtatggctacttttgtcaaaattaaaatagataatattttaatcttcactttggggatacattatttgcattccccattaagcctaactttctgaaataatgcttcaaaagacacttggtaagagtgttttcttccagtggcttcacgttaaaaaagggaaaaaagaacggctctttggttaacgtctggagtatatgtctacttggcttccaacttcattgatccctgttgaagtagctgctgccataacagatttacctgataagcaattctgcagttagctgaggaaagccattcattggggaatgagtccagttattttgtgtttttaattaaaggtatctaatgctggagtgcctgttgtttttccattttcttaaacatcacaaatcaatatttttttaaacttctcttaatctaggggctgacttatgttaattttttgttgttgttaattagaatcaagctgtaacacattcacagaacaggcatacatgctaaacaatttttccagacatctttttttttttttttaatttaacctcagtagaaatttgggggacttgttctcccagggatttgtatgatttccagctctgttacagtcaacttctaatggctcacagtctgagcctctacataagtgcttaggctgtatctcagagtgattaatgactgagtaggaaagctaaacacacagcactttgtgaactaaagaccagatcaaaccagtctggattctacccccatccctggcctctttgctcaggaccccatcctggactgttattactgattaaaaatcatctctcttttgatgtctgaatgtgttggagtgtaacaagagcactgacctgaaatgaggaggttggtatttgaaccgaacttgaacattgtctctaatacattttatcttattggatgtgtctcattatcatagcctgttaagaattttttatagtaagtttttcagacagtgcattcgatgttttttatagtcttgtgtgtttgagaagtattagttagttatgttatctttcaagtgtttgataataatattaaataataagtagactaaatctaaagaccaagcccagtggccttgtgcaggatggcatctttctggttgataacaatgcattagtcaatttttttccagtatagaggttagactagtcataaagtgacattactttgttattatccagctctcatttctgcaccttgcccataagtggagggtgagagattctttcaaatgctttattgaaatgtagacatattaagacctggccaggtgcagtggctcacgcctgtaatcccagcactttgggaggccaaggtgggcagatcacaaagtcgggatttcaagaccagtctggcaaacagagtgaaacactgtctctactaaaaatacaaaaaattacctgggcgtggtggtgtgcacctgtaatcccagctacttgggaggctgaggcaggagaatcgcatgaacccaggaagcggaggttgcaagaagctaagatcacgccattgcactccagcccaggctacagtgcgagactccgtctcaaataaataaataaataaataaataaataaataaataaataaataaataaaaaacacaaaaacacctgcattgtttcctttacctatttttatggtactactagcttttttgggaaaagagccagaaagtattcatttaaaatgtcaatagaatttcaccaataatttggaaacactgatttgtaggttttttcttttaaaacaaactcaatttattccatttaaaaaatatttggactgtatttgttctcatgttctcatatcatgcccatttttgtcagtattagcaaatagcaaattagattattcagcccctcattcaacaaacagttttaagtacctcagatgggccaggtacttctgcaaattttctccataccttaggatattctttgtttggactagaagactagaattaattcaagacagctattcaaacctaagccatttgctgaggtcgattcataaatcatgttaaaatgttagtctaacctcacataaattaatatgcgtcctttccccaaccttcacttctttggccaggagatgaaagctcaacatggacttcccaccccaggtattgatctcctttcagaatctgcctctgtattactgtttcgagagtcagggtcagcaggaatattgttttgggagaacaggtcacatattgcattagagtaacatatgattattttctgacctctcttctctttaacttaattctcagtgttttgacagagctcttgcatgcctgttccctaataaaggacaaaagacaatcattttcttatgacagtttcgtattttatctcaatctaacagcagcatgaattgataactacttgtacaagtaatgttattttatttggttcaatgtactatgactgacttttatttaaaagacccgttctgcaaattaccttggtttatacttaataggtagtttttataagcttagctccaagttaaacgttcaatgtttgttttattgaattactttctatatgaacttgagtagacagctgttttcatgttagtgagacttttttttttttctttcagactgacactgttgtgccaagctataaggagtagattcttcaggcagaggtcactcattgtctttcagttagagatttagaaaaacttttctaagctagtgctcctgtggtattgcatgctacaaagtggggaggccctttgggacatggtcaagtctttttaaagatcaaatcctcaatttttggaagagtatatatatctcatatacacagtttcttaaaatttagggtttgttgagacacatggaaaaaaatttaaatgccactgttgagtaattttatgctgtatactttttcagggaatagtcttgaactcatcggtgcccacaacttagagaaataatatttggggaacattatttgaaagatacgcaactccttctatgtttcttcattttctaaaaatctatccccaaatcaagccagatctacagagactggcacaaggaagaatcagtttacctcccaatggaattgttttactgaatcacattacactgggagctgcttgctgcatttattgccagaaagcttaaagccagtttatggctctctaataagaaatatataaatgtttatggtaaacatgtttgagctttatttctggctctaattgatggctttattcccatttttctttcttctttctgtccagttttacacttctggaattttcttgtggttaatatatcctttcagcttcctttagtcttttctagaatggaggcagaatctaaataaacaaatacaaaacatctgcagtagaaaaggataatgagaaaagaatgattttttctttgaacttctgttctgtggtcaaagacaatatttctgctttcttaaataaaatagcctggtaaatgctattagtagacaaataaagaaatttgtatttaaattacttacagataccataaaactttatatgtgttgcctcaagtagaatcttatgctcttgttgttgaataatttagtatattggcatttatagttaagacatcctattttaacatgattttaatagtgaatcacttaatatttaattaaatagttaatgttaccttatgtgcatacttaaaattttttttaaagtttacatatatcatcatactgataggaaaagtctataaagtaggcaaggtttatatattacccccatttaaaaggcatggttgggttatgacttgccaaaaaacaaaaggcaaaaaatatatcatgtggcaaagaaaaataagacattaaattttgaaagaaccttatgagtcagacataattcatcaagtacagtttgccttttagttttatgaaatattaatactgaaagggaccttagaaagtattttgtccagccttctgattttatgagtgaaaacaaccaactaattttagaacattcaaacaagtattagaacctctactcaatggaaccatatttatcccctgtataacttcaaatagagttgagtagtctaatgtatattcccaaatacgaacattaagaactttaacacctggttcagtgttttgacccttttaacctctcattactgtaaccattattaaaactaaactgtactgtcttcagttagcaattgattagctcttttttctttagagccaaatagaccccaaatgaaaatcttgccacaggcccttgaactctttcttttactcttcccatgtaacattatggagtttgccggttggttataaatagataaataaacaaaaacagagccaaacaaataaatgtaaatagattaacatatcagggctctgaacactcagcttcacatagaaaaaggtaaacaaacatagataagtaatatttgcagcattgtttataacataagagcttgagtcagaatcctttgagttcaaatcctcattctctctcatttcctgtaagcttggtcaagtgagtcagtaactgtagctttgtgtctttatctgtaaaatagggatgatacctatatcataagtgttatgttatgattaaaatgaaagtgtgtgttgtacagtgctagtgaagtataaggaaatatgcatggtaagtgttcattctaacatttggtatattgcaatcgcacagatttatttttttcttctctttggaaacaggagcataacttgcttatcctataattgaattatattattataaggtgttttcaaacaggattctattgaatgattttagttatcagacctcaccagcaccaaaaaggccattttaatttatattgtttttttggttagctgaggccagaaatttgtcttctgaattttttcttgataatctaaaatggttcaaacagacattaattttagccagactttcaccatttcagtttgtactctcctgtaatctggtctacaaattaaatattgagacaacatacttgtcactttttggaggcatttctaaaccatttgtttggatacagagtaaaaatacttttaagtttatttatatagtgatcaatggaacaacctgagtttttaaatctgggtgtgaatgctgatgattgcttctgtagatcatttgctcaaggagctgtgatataattttaaatttaattcatgaaattgtagatcccggaaagtagtttattatgagacgcatagtaaattttaaaatgccctcaatagtattttcacagtatgtttttaataattactaagttgtcttcataggcccataatagacttagcaaaacactggtttatatttgtagttttctgaattttagagaatgtgagggtttttaagtgctggaagatggaatttagtttgtcagggaaaaattctaggcagagcaagtaaaccctgtattctgtgttgtaggaatgcagttctttcaggaaatttaaggcagtaacaacaaagcaacaataatttagtgttataattttaaaacctattgtttctttgaagtggtgggtcattatttagacttgctattctattggcaaatattcattttaatcatattgtaaaggtataatttaaatattttgaagaggaaaaatctgtaccttgcataacagagtcttgatcctttagggctgttagtctagtagattctgttgttttcactcttaccatattaataaattcaatgaaatatgttcattaataataaaaaggcacatcgcttatctctgtatgtatgtatttggtgaaaagggggagtataactttataagagttttcattttgcttgctgaacaactaactgtttgattttgatagtgaggagaaagcatgtaaaattcatactattcaggtgcttttgagacattacagtgataaattgcgacttatgcactgactaattttccatgtatcctttactggaatgtttcttattaggaagtccatgagtgtactcaatggagataaccctagacatttcattcctgaatctcaaatgaaaggactcttggcccaggacacttacacgttttcgtctggagttcaatcttgaggtgattgtagcagaagatgttgcatcttagactgtatgtctgatggagttttggagattcgggttcataatgtggggacagtggatctcagtaggttgtttagttttgagcttcaaaggcttgtaaactcaattttacataggaaggaggatagatgcttttcatagaatgggtataggactttgcaaagattaagtgtcactgctttctgtaaacagttgatagttatacaaaataaagtccatctttttttttctttttttattatactttaagttctagggtacatgtgcacaaagtgcaggtttgttacatatgtatacatgtgccatattggtgtgctgcacccattaactcatcatttacattaggtatttctcctaatgctatccctccccactcccccgaccccgcgacaggacaggccccagtgtgtgctgttccccaccctgtgtccaagtgttctcattgttcaattcctacctatgagtgagaacatgcagtgtttggttttctatccttgcgatagtcagaatgatggtttctagcttcatccatgtccctacaaaggacatgaactcatccttttttatagctgcatagtattcaatggtgtatatgtgccacattttcttaatccagtctatcattgatggacatttgggttggttccaagtctttgctattgtgaatagtgccacaataaacatacgtgtccgtgtgtctttatagcagcatgattaataatccttcgggtatatgctcagtaatgggatggctgggtcaaatggtatttctagttctagatccttgaggaatcaccacactgtcttccacaatggttgaactagtttacagtcccaccaacagtgtaaaagcattcctatttctctacatcctctccagcacctgttgtttcctgactttttaatgatcgccattctaactggtgtgagatggcatctcattgaggttttgatttgcatttctctgagggccagtgatgctgagcattttttcacgtgtctgttggctgcataaatgtcttcttttgagaagcatctgttcatatcctttgcccactttttgatgagattgtttgattttttcttgtaaatttgtttaagttctttgtagattctggatattagccctttgtcagatgagtagattgtaaaaattttttcccattctgtaagttgcctgttcactctgatggtagtttcttttgctgtgcagaagctctttagtttaattagatcccatttgtcagttttggcttttgttgccattgcttttggtgttttagtcatgaggtccttgcccatgcctgtgtcctgaatggtattgcctaggttttcttctagggtttttatggttttaggtctaacatttaagtctttaatccatcttgaattaatttttatataaggtgtaaggaaggaatccagtttcagctttctccatatggctagccagtttttccagcaccatttattaaatagggaatcctttccccatgtcttgtttttgttaggtttgtcaaagatcagatggttgtattggttttaacctatattttaatgactaatgcatatgtggataaatctgttacaatcagtcatgcagaacttcattatagttaacactaagatctttgctttaggaaactgaattactatattaacgagtactattaatatgataattcttttaattttcttgatacactacacaataaacctttcagttcaatgttaattttaagtaaaactcttgttccaactcttcaaagtaaagtaaataaaccagtcaaatgtgctaaaggcacaagcagaagcgttggccagagattatgcatctatagtcttggaggagaaccaaagatactataatcacaatttgccaagtctgactaatgactccttcaaagttgagaacaccagtgtgctgctagggttttgtgaatgctttaaactttgattgagaagggggtcttctgagcttaggccaggctgccagtagggatttgcacctgatcagacctttcttttttttgagtacttaatagctgcttctgccagaaaaccagatcaaagaatagcaggggagattagtacattggttttatcagccattttccagctacagctcttataaagctgataacaggataggggtgaataaaatcatctgctttcaacctccctgcagtgctttcatcttgatttaagaaccaaggaggaccatgtctacagtggacaccaggccggtcccctctccatccctgtcagagtttaaagcacttaactagtaatcactgctctgactctggagtagtcagctaccatgtttcctttgcttttgacttggcaactgctgtggcttctttagcacctggtcctctgccagccatctcagttaccttggattgactacagaagacttttttgaggtttgtatttctcccactattatgaaggcaaacggttgcagcctctatccccctccctaggtagatgacagaacacatatagccttttgtctatcctttttttttaataccttcaaggctactcttgatgttaaggacctaaataaaacaaatcttacttgcccaaagtggacagtcgaagtagtcggaatcatagctttttaagattttttttttaagaccttagctatccagttctgccctctccttttatacagcatatgtgcagctaaaaacaaagcattggtctcttaatgcctgattggtacactgatgtctccttaaccaaatagtatgcttggtctatttaaacagaatgattcctgagatggttttggctgagaaataaattaaaattttctgaatagcattttgaagaaatgtgtactatctgaaaaatttgcaaaaatacattctaaaagttaagactactggatgctgcgtattgtacattatctaaagacgcatatataattgatgtttctgacattgctagtatctgtattgtatatggaaaatgcttggaattgaatatggtggaattgcagttttaatggaatatgcttactttgtaatacattgactctccttttatattcaatgtgtactaattagttatggtcactgtatgtgtcttcctaatgttaggggttgaagtataatagattgtaaaataccttgacctttgagccagtagaactcagttaaatttttatttgtcactaatttaatgaagcatttggaattctatttaagctatatgtgtcacttttctcatcccagaaaatatgttgatccattttagatactttctaaggtttcctcagtaggaaaatcctaggagaggacttagaatataatcttactgctcaaaatgattatatttatgctgattgcatatttacatttttcttttattttaataacacatggttgatattgttgtaatttattgatgtcaaaaactctaccaaaattataatataactatgagaaagtataatcccctttacagctatcttgttttatgaagtggtttccaggaaacgatcttagcccaaaagccagaactgcctattatgggataaggataatcgactagcaggtacaatcagcagaaaggaaagtgaatttacttggtttaaagactttcttgcagtcacagaaaatgctaaattgattttgtttttctccatagaaaaactgcagcacgttatataagaggagttgctttgggagactataataccttttacagactaatcagtgattttaggaaatgttgttgttggaattagctggaaactttgtaattggaattgactcaactttcatcacaatctctctctcctcctttttttcatattaaaatcagctgatgaattacattgtctctgtaatgtgtttcatatccagtaaccttctctatttccaccagcatatggatttctatatgccattctcccaattaagtgccctcccctgtcatcgacatccaaatgtagggcaccctgcaaggtgacattaaatgcattttctttatacactttaactgactttggagaatcaaaatcttttgcctctctaattataccttttttttttttaaatttatttttttaaccatcctgttagttaagatgccaccctcttttgggcctctccagcttcacctgacagtctctcctctgtgtttcagcagatttatgtagctatctctgtcatagaccatatgatgtcctcttgttactacctttattttatctagtctctggctttttggctgctgggattgtctttattttagctttgttacccattgccctgcagcagtgcctgacatattacagatgctttctaagagaatttatcttctcttgatgacaggatccatgtattctaccctatcctgccttctatacactgccttgcacagtattgggcataaaatttggtgttaaagttaagaattgccccttaaacccttatcataatttaagtacttaggtattcttgatttatgctatgtgttgttttttgaactcttaatgaacatcttcattaagagttcatatttacaatttattggtggaaagccaatgataagactaataattattcccttcaggaatgttaaccatacagtttctgatttcctaccaaggtaagaaaaaagcttgaaaagtatctctcaatagaatatttaaatcctctgtgtttatttacctatgtgttggtaaactcatcaagaaacattttagttatctcagtttatcttaagagaatatatagctagcaaagaataaaatggtaagaatggattcaatatattgaaagtattttactttagatggctatatttaaaggggacgtagtactccagataaaggactgatttaaaggtaggtgatcaggtgactgtacagtaattttattagagccattctgttttagagattgtaaaacaaatgaattgttaaaaataattttactgttcactggggcacaatgattattacagaataatgactttttgttggcaaggcagttgggcaaatataagtaaaccattttacatttttcgcctgtctttgatgctttgtctttctgaataaggaccccattcccaagaaaggcgaaatcataagcatttctaatagctctgtcttctttcatataaagtttaattaatggttctctcactttttctgcattttatgtttcctctcacgtagaaaatatgtctttttgtgctcaataattgatgacccttggagtttagtgacaaatgtgagttaatttaagtcatcaccatcaatttaacaagcacctctggtaatacgtttttcacttttaaaaaattgtatcatgaagcaaaatgtgtttctctgggaagcagcaaagattataagataatcacacacctctagggcatgagaatgggaaaggttcaggtaaatgtatctattcatttgacataatgattatttcataataactgaatgcttccatttcagccttccccaccgccactatcccattcctccctattctgttagtctgggagaagaataatataatttttcttgtgtgctaaaatatgatgctggtagttttatgatggttccgtatatattttagctgaactgtacattttcttataatcactagaaaataagaatggtctcttagccccagtagttgatgtaatagtgaaaagagatatatcttgaagtcttttgctcacgcctttcccaataaaacttatcagatctcctttttccagaagtctccaatttaaactcatattctgctgttacttacaattttgatgtacattcatgtgtttgtaggtttttactgtttgtagaatatttaagctaatagttaacattgtactcaatatttcaagtactgttacatagccacagttccaggactggagacaagggattgtatatgttgttattgtgaactgtggtgtcttgtggcttgtttagtcaattactcaatataaacttttttgaggaagttttttgggaattattggtaatagccaactattggagaggaagttacacagttttaaagagcattggctttaggatcaaatccagttaaaataaaatcccagtggaatcacttgccatctctttccttgtacagcttataaagtgtttttattctctatttttattatggctatcaggtacaaaaataaaagagagatatttccccccatggaatacatgggttttaaatgatacagcagtcaataggttttggtgaaataataaataagacagaagaaataagagaggacataaaataattcatattttgtggactcatctagtgatttctcttcttggtaaattggttgaaaaaatgagttacatttttgcctgtttaaagatgcatttatggcaggtagataaatcacagactttattcttttttccatttacttcatactgactcatcactgatgcacacccagaaaaataacaaatcagcattaatatatgagcctttttgtttctgcttatttgtgaaaaacttaaatatcgaattagcattgaattagctatgtgatttcataagatttttatgagattaataacaatgttcaatatcataataaataagtttccttacagttgatgatttctagaataaagtgagatataattttcactcagattgtttagaatttttgtttttcagaaattactctttgctatattcctccttcacatcccacttcagttttggtcttcacttccatgcacaagccccgctggttaggctagcttgaaaacattgttttcaggaagcacacaaaaacttccgagttgaaagctggttcagcacaagtttgttttatttctgactccctgtgagctttgcttggattcttccctttggcattgtgtgtgcttagatgtgtattcagtatcctgcacttttggacatgttgccttccatgttggtgttatagtctcgtgattctattctaggaaagaccttagattttgtggtccaaggatgaaaattcatagaagaaggaattgtggtctggagagagtaagtagcataatcaagattcaaatcaggcttgacctctaaattcagtgtttcttagcaaattgcacgtaaacttattcttttaaaactgcctaatccagtgcttttcagactttttccacgttggtatactgagcctcattaacccatctgtctgggtccccagtcactgccagaccactggaaagtgaagggaaacaggtatttggtagacatttgctatgtgccactgtgcagcgtttagtgatattgtcaaaagttcaagcaatagcacttacttctgtgtcctttcccagcctcaggaccttttgctcttctagtagctttagccttgtttgattcttgttctgtatccacaacctactgccgtccttcctgcaagaaaatgtgtgtgctagcttagtcacttcagtctgctatagcaaaatgccataaactggatgtcttataaacaacagaaattgatttctcactgtcctggaggatggggagtccaaaatcaaggcaccaacagacttggtgtctaatgagggtctattttctcgttcatagacagtgcctactcactgtgttctcacagtgcagaagaggcaaggatctctcatgaataagggcactaatcccattcaccaaggtggagtccgcatgacctgatcacctcccagaaacctcacttcctaataccatcgctttggggattcaaatttcaacataagaattttggagtcaaacagatattggaccatgacatgtatgaatttttaaatttttaatgtctctaaaatacactaagaagtaattaattaaatgttgtaccaccttagagattcaaatgctttcaaatttcaattcttagttcagggcaaaattttgaaaggtaattccatttgatgagttcacttatatatcacactgcatagtaagcaaaatgcaagaactgtggcaccagactatctgggttagaatctggtgctgccactgaatagctgtgcgaccttgggagagatacttacctttctttgcttctatgtcttcatcagtaatattgcccctacctcatagggttgttacaagaaccaaatgaattaatatttaaagcagttggaagagtttctagtacatgatcagtattatctatgtgtttgttagcaaatgactaattaaaaagttatttatatttatagtaaattttctttaaattgaaagtttcaaaaattagttatcttagcagaatgtatgtatatttgccacctcatgtataataatcaaatcagtcctaaatcatgtagcttttgtggtgatatgatgatatacggagtaggacaaggtatatcgggtaattgtgtagatctttgagtgtattcaaagtttggcttttaagtgagcttgtcacttcgtttctctcagctccatttttagtatctataagatgtgactattaaaatctgttctacacacttgtattagtctgttttcacgctgctgataaagacacacctgagactgggcaatttacaaaagaaaatgctttaatggacttacagttccaattggctggagaaatctcacaatcatggcagaaggcaaggagaaacaagtcacatcttacatggatggcagcaggcaaagagagagcttgtgcagggaaattcccattttaaaaatcatcagatctcgtgagatttattcactatcacaagaacagcatgggtaatacctgcctccatgattcaattatctcccatgaggttcctcccaggacacatgggaattgtgggagttacaattcaagatgagatttgggtggggacacaaccaaaccatattaacacctagcaagtgttttatggggatcaaatgaagtaatgttcatgaatatactctgtgagccaggtatggtggtgcatgcctgtagtcccagttattcactgaagtgggaggattgcttgagcctaggagtttaagtttgtagtgcactatgatcatgcctgtgaatagccactgcactcgagcctggacaacatagcaagaccctgtctctaaaaaaataataaaattaaaaatactttgtaaactataaagacctatccaaagtaaatatattcttaatgatgacgacttatgtatttaaagcactgtacagttttttgcatttgctgtaaatatatgatggcaaaatgcttacctagaagtaacagaactgcatgtattactgtgtatctgatatcaatatttaaaatagtgggctgttcttctttaaagaaaaacttatctttgcttatttttaatttccttgttagcagtgggtgcttagtacaatactccaaataatatcactcctgagtttggaacagacataagggaggcaggcatcttcttcgttaactggacctacatcagatgtggggaggaccccccatcttcctctggcttttcttcttttgtcatgttttagctttgctgccaatctccactgatgggtatggcttttttctcattgttggcagggtagtttgcttgatgtagtagtctgcttcataccaacctcctctatcttcaaggacctccttggaaagaaacagctgtgcttcttctggagcaaagtggttcactactctggcctttccaacggtggtggtctctcacttagatgctgcctgggaagcccttagagtcccagtgccacctctacaaggtactctttcatgtgaagacaggaaaacctcttctgtgtcctcatgacagcagaaaaactcccatacacttatcaggcacaccactggtgtgcaagagcggcttgtacagactctcaaatgctaactgttaaatttttaggaagttgtgatcttgttgttaacacaatcattactaattatattatgtaagtgattaatcaaaaagattattttagaaactgtactaaatatttaaaatatcactttcttattattttgctgcattttgttattacctgtgctcctgatattgctttatatctgctgtatttttatggtagataataccgtataatggtgtgctactgcacatctctccccactccacattctttaacttcacactagtagcttgaaattggccatggtgagagcatttctacctctgaaatcaacaagtgccacaaaccatgatctgtcattccctgccatttgttgaacatttaccagcagactactgggctcactgtattctggtctcttctggttctactgctacaggctacagcagcaagtgttccctcattaatagtctctataatgagaaagaaattgcctcttccttcttaggactttttaccaagtcctcccaagaactctgtcatgaagcatttatccagaagtcagttgccagccacctcttctcataggcaccccagtcttgactgattcttctacagtcttccttgtgtttggcccagggagcgttcctgtggggtgagcactcgcttcccttcctttgtggaggcaaggaagctcatcactatcagtactggacttctctgcctggtcctcagggctcagttcagatcagctgggtgtatgaaggtgaaagactatggtagacgtgggtctgccacctcccagcaaacactcaaggaaaattggcccagttttttatgaattatctagaatgtaaagcacttagacttttttttttttttttttggttattggttttggacccacctaaaaattcttgggaaaaaaaaaaaagaagtaccatttaactttgtattataaaaaagactgaaagggtatttcatttacaaaatttatttcacaaaaaagacttttcgtataaatgcatcacattaaacagaaaggtaggaattcctgatgtctaagtgtctagtcctaaactgattttccaaagcaactgagagtttagttggttttggagacagtgtctgtcattctctccctctccctccttctttgccttgccccctccatagctctgtagttgggtctagtttagggcttacctatatgaaagattaagtaaacactctgttcttttctttgggaagttagtgttgttttagtatgtggggagtcgaacactctttaaaataactcatttctagaaaacaaaaaggccaaaaatttaggataagataacagatattgaagatcaatgattacatattaagtctgtcagtgtgattctcttgagataaaaaatccttttttaagagagtatagtgcataatatatttttgcttctatgaacttatttggtttcaataatttaatattgaggctgtctcacattttaaacctagggagaaaacaggttggaaactacataaaattggtgtatcaacagttttgagttgcagtttaactttcactatgctgcttaatttgtcatccataaaattgggatgaatccaaacctggaaagtaatatttgactgtaataccaagccatacagcattgcctgatccacataaagcacacttgatcagttttgtcatttgcacatgtggagagttttctcaggctgagtaactcctggtattggattctaggcataatcatgtcattcttgcttgttggtgccatgaaataattagcccaccatgtaagggcccaacttgatgctgtgcttaagagtagagcctatattcttgattcttgtggaatttgtgtcttatatgaaagtttgcttgacccaccagttgcttctttttgcttttaactgttaatatagctccaaaagctattgcccaaatttgtcaaaattcatatttaaaagttctgctgttcaatgagctagtcactagccagatgcaattattaaaattaaaattaaaaatgtatttattcatttgcactatccacattttaagtgcttgatgcctgcaggtggctggttagtggctactatgtagacagatacagaacatttttcttgtggcagacaattttgctggacagttttgctctagactgaagctctgcacacagtacttcccctgtaataactatagacatctggctagtttttactgtgttacaaacattttgctaattcaagtttggagacaatggatttcataaagaaattataataaaatatacctgtcaatgtacaatgtagtgtttcaccatattatgtaataaaatatcttaagtgctagtttggaaaatttgctgttttttgttatagtgtttttaacatcttttgccctctagaacattattctcaaattttaaatccatataactattgaaaaatctgtataagtattgatttctgcttttacatctttaatcatatgaaccaaaagaaatacaacaatgaatcatctaatatgtttgaacaaaaattgatgggtttttcttttttgaaagttttatttggagcactgagcttggaatataaaataaataaagacaacatggaatttaaatttggatgggtaaaatagaaaatgaagtttagaggcttgatagattgacagatcaagaggggtaaaacagaaactattgctatataagctcaggatgaaatactaagtagagacctcagcctatacataaaaagagatggaaaaactaagaaaatgcatgtttgttttgcaatttaaatttttattttcagatcttagaggacaactatatcattaaatgttaagcttgctaaagcagtattttttaggtgtctttaaagtaacttactacaacttcctatatttttgcagcatcttctaatgtacatgaaagttcagtgaatgtacatgaaagttcagggaccacatgcttaaatactggagttgaacggagaactaagcttgttttgaaataatttttgttgtccctgcttccaaatttgttgtggtagtggttatatgagtcttttatttattaggagattaggaaactgctttcataaatggacattatacaagcatcttcaagaaacatgtttcgcttctccagctccaattagaaaagcggtaatctccatcccagccttctggatggctggcctctcttcctaactttcttacccgaatacctctttataggaggcttactacatgccatttgctatgctagatattgtgggtagcaatgataaaggccatcttctctattttatttttgggcatcctcagggttaatgccgtcatcttttccttcaacaactgcagtggtctccttaacattgtctctgcttctggatcttggtctcccacaaaccacttctcacagtcatcaaaacaaacttcttcagatcataattcagattatgtcactcctctgctataagcctgttctgttacatttagaatgaaatccaatcttttaaaaaatagaataaaaaaaaatatattttaggaagccatgtcatcagaagtgtaatccagagaataatatactctataggtctaaaaaaagattttctaaattatgcaattatattttgataaatacttataaatattcaaatacagacatcagtaaaatgaaaagtgaaactcatttcacccatttcattcaatttctcccccaagatgactactgttaattgggtctatatagtttaaggcctttcctatgaaattacgtccatgttgtacgtttgctttacatatgttatggactggaaaatgaaagcagttgtgtggaagggttcttatgttacagaaggaagtcacatttttttagtttccttttaactttctttaaatgaaaaggaaagaatgttttaagttatatcttcaactgctagaaaggtagtatacttagaatttttatggccctttcctagggatttatgattttcacataaaagaatgaaaattgaacacacactgaattatacttctaaaacatacttgaaattttttgcctctctctattcgtgttacttaaccagtgcaaacttactgtaagtaacgaaatcattgaagaaatacacagaaaatgaaagtaatccataatctcaccttctgctttctagagatgactcctaatattttgacaggtggcacatacatatgcatgtatgtatgtgcatatatgtacattatatatgtgtgtgtgcatgtgcatattaaacttgatattcagtggaatcataatacataatgttttggtttccttaattaggttattgtgaaaagctttcctcttcatattctatttttaagcaacctgtcccaatctgacaatttctcactcttagtttagtggttttgagctgtggcatactggtgttccctgacagtggtattgcaggtgttgaaaaatttgtagtgtgataacctagcctatagggtggagcctggaactatgacagttgtctttttacttcaaggtgccacacagttgttgtcatctcctgtttgtttttcataatataaaagcatttgggaagcactgctaaaaatccatgctttccctgtctccctcctcaaacatggacctccccacacttctcccagcttcccttattacctctctgaggctcttctcctcacagcagactgatcttttaaaaacacatgtcagatatcaggaacttaggaattctaccccatatcctccactggcttctcaatggagtcaataaaatccaaatccagttattggctagctccacgttaaattgtcttctgctctctgcctccctcattcagctttctgatcgtggaatgctccaagatcattcgtatctcaaagtctttgtgcctgtcattccctccgcctggaatggcattacctccatcttcccattctggtctctactcatattttgccttctcagaggctgacctaattaccccgtctctacccttctgttcgttaactcctttgcctccttgccttagcactttggtcactgttccatatgcttgtttagtgtctttcttccatactagcctgttttccatgaagacatcaactttgttttatgtttttcatctcttgtacatatcaggtgctcgagaaataattatctaatgaaaaagtacatatacaatgaaaaaagtacatagcgaaactaacatttttattcagtatttgtttcctttatttcattttcccagtgccttggatttttctggtcagttatctctagtgttagcatgagcacttcaggaagaggtaagggagagatattagccagttaaaccatgcatgattactctgtgatatcagttttatgtaacatattttgatctttttaacatagtcaaatggatgttgtaacacttgcttgatttaacattatattttggtctttattatagaaattttaaggaatttcacataatcactattttcttatagaagaatatagggacaagcagaatggtgattttcttaaaggccttatttcttaaagagaataaaatttagtttatgtataaagaaaatgattttattctcagacactttcctccctgtgtgtatcccctcaaattatcacatttaaataattctcagtggtcctaattgatttctgaataaaatatattctggccatttttctttctcccaggatttattatgagccatgacaataaagtttaggtctatttacaaatcagagaaccttcatatttttgagaactggaactttgaactagattagttgagtatatcatgttggtttttttggtgacacgcagtatagagaaaattaaaaatgaatttccatcacacctatctttgaaaactgaatttagcttaaattgaaaggggtgaaaagttggcattttattacatcatttcacttatcttataaatcttagagtgaagacaatgtttatgacattattttaagtctgaaattaaatttaagtgaagcctttctgagacttatttattttaaacacttgttattgcattttggattaaaaaattacatacacaaatttgttttcctgaatatataatgtgtttgatctctccataaatatgtatgttaatatagcactaaaatctaaatctttccacattattgtacacgtaggtatgcaataaatatttcttgattggttgactaatatccaagcatatttaggcatactattacatgtttaggtctttctgatgagattccagttcttgaatctggttgttgctaccacactgacctttttaaggtgcaaatcacattatccctcatgtagaaccctttaaaggcattacaacaccttcaaaaataaaataaaataaaatgaaaaaaggcagactcctttttgtggtgtagaagtccatgcaagataaggtcccagcttcctatctcccaggtgtcttttttttttttttggatggagtttctctctgtctcccaggctggagtgcaatggcgtgatctgggctcaccacaatctccgcctcccatgttcaagcaattctcctgcctcagcctcccgagtagctgggattacaggcatgtgccaccatgcctggctaattttgtatttttagtagagacggggtttctccttgttggtcagtctggtctcgaactcccgacctcatgtgatcctcctgcctcggcctcccaaagttctgggattacaggcatgagccactccatctcccaggttttaatctcttctgttctattcttcctaactagatgttctacaaaattgcttgtgccaatagctcattatatttcctcttgtcagtcttttgcaaatacaccttatttggtctgtaacgccctctttttttgcagtgttttaaaactgcttggaatcatcttttttttgaatcattgtccgctttcccagatagaaaatagtttgcctacagccgggcatggttgcttacgcctgtaatcccagcactttgggaggctgaggcgggcggatcacgaggtcaggagatcgagaccatcctgaccaacacggtgaaaccccgtctctactaaaaatacaaaaattagccaggtgtggtggcatgcaactgtaatcccagttactcgggaggctgaggcagaagtgcttgaacccgggagttggaggttgcagtgagccaagatcgccactgcactccaacctggcaacagaacgagactccatctcaaaaaaaaaaaaaaatgaagaacatagtttgcctactctttctcttgttttacattattgctctacatatgtcatagaggtttaccttctaaaaggtgtggctctgccttttatccatcttcgtatccctagcggctagaatagtgtgtgctcactaagtgctgggttaatgaaggatgtttcaaaggtcgctttctctgaagtcttgctgttttcccaggtggagtaattttctctctcccctgaactctcatagcgttctaactctgctttatcacatataactgtgctatagttatttcctaccatgcttatctcttctgccacattgtgactctcttgaggacagggaccaaaaattaggtatttctttctgtcagatattagtccagcaaatattagacactccataaatttcttcttgttgaataaatacatggctaattgttcaaatttttaaaaattggtattttatacaggcttatatttttgttttagctggctatctgataaagaaaacctatgaatctacttacagtttttttcttgaaaaggaaaaagttctgaaggaagaaaacctataggattgaaactgtcatgtaacttttagctcagcttggagatcagcctagatgaatggttctcacattttagcctgcatcagtatcacctgcaggagctctgaaaccatggatcggtgggtcccacccacagagtttccaagaagtttccaggtgttgttgatgcttttgttgccaggaccatgttttgataacttttgacctgatctgtcttaccagtatttttcagccttcagcatcttgataatttgttcatactttaatgccgatatgtggagtcagtgcaaaggttaaacaggttaaatatctcctgatgtctttggcaaaggccttctgttttcatagacaacatctaaaatcatttgagtggctctttcagtcctcctaaatcactttatgttagtttctattctatacactctttattaaaggaggcacttggtcattataatgtctagtgctttccctcacttatgactagatactgccaataaaattaatgctttccctcgtctttttcaccatctcccatattgtgttctcaatgaagatgagtttatctctctccatctatccttaaaacctgatttagggcccggcatggtggctcacgcctgttatcccagcactttgggaggccgaggtgggtggatcatgaggtcaggagatcgagcccatcctggccaacatggtgaaaccccgtctctactaaaaatacaaaaattggctgggcatggtggcgggcgcctgtagtcccagctactcaggaggctgaggcaggagaatcacttgaacccaggaggcggaggttgtggtgagctgagatcgcgtcactgtactccagcctgggcgatagagcaagactctggctcaagaaaaacaaaacaaaaccctgattttattccacttattttgttttatatgggtaacaacattggtctatgaatcaggcccattttaaaagtagagtttcaagcctttataattgtacaaaaagttccaaggatttatttctccctagtatttcttaatttctctgcttcaacccatttttactgattgtcggacacccagagaggtcataggtattcttcaaaaagtttgtgatatgaaaaggatgtcgtttccttcttttttttttgactaacttctgaataatctctgagtattctagataaaaatattttgccttaaaatttttagcaagattcttaaagtcttacagacttcatcttttgctgatttatgacacatgaatattttcttaagcatatcgtcaaaaatttgagttcatcttctgcaaagaatcaagtgaaccatatacttttaatgtcttcattttaaatatatgttttaagaaaaaagtcaagacaaatatagatatgcatatttgtgtgtttgcacccattatttttagtcgttctgggatatcttctaaagttccctattattttctcctgttgaacctgactgtcaaacgtattgtttgttacatctcttcgtaaatatttttcaatttcagctgggcttttactagctaaaagcactaacatcataaattatataataatatgtaattatatttgtgctatttaaacgttatatagctaatgatatcactgttcttgactatttgtcttgtaaaataaaacagaaaataaaagttcacaggcgttctatccctaaattcaactaagagtacacaaactagttactcttacaaactttatgtcaaaacctttctcctctcccctccaaccataactaattttttcagtagggaaagttcacaatacttttgaaattacttaattcttaaatcaatattatgtaagtagagaattctctttttacaagaggtttaaacaaaacaattacttattaatatatctgaatttgtgatgtgaaaactcaagtttagcatctggctgaactttgtctgtatgtaggctcatccatttatcttatctcttcactcaaaattaatcatctggtttacttaaaggttgcttttctttgtaagtgcatactgtcatcagatttcatctgttaatagatatttagtatgatggtacatgtaggctgaactactgattttaattttcttgagtttcataagcataaattaaagctattgagagttgtttaaatttgttaagaacagacttactgtgttagtttgaaagcattatttttcaaatatagttgtgcaggtgaagtgatctacttctgctatgtgtaagattggactgttggtgctgaaatttaaaaggttctgcttgtggattgtaggaagacaaatggcacatctctagaagtgaggagaaatagtactgtaattcagtgtcatgttgatagaagtagaaaccttcaccagtcatcttttatttttgtaccagacaactaactataaaatataacccagatggtggagctatgatagtaaagatacagaaatgacattttgctgatgaattttctgctactctttgcttccccactttcagttttataccaaatcttttatggtgtaggttgcttgcttatgtatctaaggacagatccataggatgaaaaatgtgtttaagggcatttttagatcttggattatttcagtaaacttttattttcctcttttaattgcctttttggtttttcctctctttttgctaaactcatattctcacataaattagactgagccatgaatagtgggtcctatttcaattttatttctgagtttcatatttaaggcatttgggatgtattattatgctctgcctgtctgtctgcctatattggaattgggaagcctcagaagagagcaggggtttggcataccttatactgtggtctctagtctcaggcagcttcaccacacttaggccctgaattgaactgtaaaaggaattatggaaaggggctttagtgataggggtgtcagacattaggaatgagcaaggtagtgagtttgtggtactgtttttgtagcacagaagagctaaaaggtgtatctgcgatggcaaaggtcaggaaaggggctaacatttatgagaaacctcctaatttgtgtataatatcttttaatctttacaatggcctcatgaggtcggaactgggacctgagttgaggtctgtggctcagagttggggctctgctgctgggaactgtggtgtgcactgtgttgagtgggtgtgcttgtgtgtgtctctgtcttaccttgagggtctatgtcaaaaccttcttgagaaagcaagtatataatcccttctacccccagagccattttaatgatatagagaatatgcagagaacacaagaactttttgtgggtttattttgttaaagttattcattctcagttcaggttttgggtttgttttcagaaatgagaagtatgtcttagtcactttaagactaagaagtcatgtgtttttgatacatataaacctgcgtcaacatctattctaattaaaaacaccattgataatcgtttacaagtgcaagatttcaggaatgcagaattaatttaaataactagtggactattattataacttcaacatactagcatacactctgaaatgattattgttcattcatttatttagattttctagatacttttagtgattacattagggatagccaactccctgggctaatttgaaacataggaatgtagtatgcttgcatattcatttcagtatggaacttgtgaaaatctccgtctttgggcttttctttcatacaggctacttttgtatgaagtctgttaggttttattttctccttctgatctgtggtcctgactttttacagttacctggacactgccatgtgctttgactgatgttctgttgtttattaggcaaaacacagtatcattcttgaaaggcctgcagttggtggatgctctagctgcttttcatgcaactgcactctggttatacctgatgtcatccctgttagataatgtggtagtccttctcatcatgcaggcaattggtaatgctaaacctcaggatatttttgtaatcaaagcccttgtaattggataaattgatgttttattaaagaatacctggtaacattataaatagtattaacattctaaaattaacttgtcactgtaatattaattacagtgatatatggatacatagaattatgtgggcacgtgtatatatgtatgtgtgcgtagatatatgaaagtgaaagaatatttaaacctatactgtagctcctgctgagtggcagatgctgtaactatgcaaaaggcctgtgtgtattcaggtaagagaatgttggtatttagaatctctggagccctagttactccctgtagatagtaaaatcctgatgcgaagtcttgataatactagtctttctaaggaaccagccatttttaatctcaggacatcttaaggaaaattatgcatctatgagtcatggaagtgctaaggatagctaaaatctgaaattacttaggggttagatgaagaatcgatttgggcttgattatatgtcttaattgccttccatatttagttggcatataattagaaccccctcattactttctcaagaaactcgaaaatcaaagagtttacaaatagtcaaataattgactttagcaactctaaagcaaagagtatacaaatatttcccttgtttagatattttatctatgtatctttttgtgattgcaggtatatatctccttcaggaactaagtaaacaagtaaacaacaaataggaaaaggttaataagaattcatcagtttcagagtctcaaggccttgactaaaggccttttcacactttagactcttagaagtggactattacatgagtcaataggcaaaccagcctgtcttgcaggggtctgacgaagagaagctccttttctctaatatttgctgctgattcttagttgagaaaccataattccaaattgccagtgtctatgagaggagctacagtgagtgacagtaactgctagttgtacattgcacttttggtatcacctgtcagttatgtgtgtcttcatctttatgtatggatgaaaatagaatatgcacatttgaaaagtaactagattctagaattttaagttttcatgtagatactggacttactctgtagaaaatcttctggggcctatcagcagaaatttatgccttatagcattatttagctgttcaggggaggtttatgttttcatgatttctaatatagcttgggaaaattatctagaactttctcaaacaagtgtcattgtattatttcaacacaattttgtgagttcagcaaaaatgagctaaatgtctattctcatatttcccttttaggtaaaacagttaatccactgatactgcattgttgttttctgtgacatattgggactctttgagccctgactgtcaacaggattcatgtggttcaatgatgttgtgaggaacatgacaatccattgccctcagtgagtttatattttactagaggaaataaacatcaaatgtttacttagagttaattatgtaattataatcatcatatgttcatggctatagcctacagacactttttcccaaatattctctaaaagagaagatattaattcccaagtaacttaggtcaatgggtggtgtattagttcattttcacgctgctgataaagacatacatgagactgggaagaaaaataggtttgatagattcacagttacatgtagctaaaggcctcataatcatggtggaaggtgaaaggcacttcttatgtgccttggcaagagagaatgagaatcaagcgaaaacggaaacctcaaatctcctgaaaaccatcagatctcgtgagacttattcactaccatgagaacaggatgggggaaactgccttcatgattcagttacctctcactgggtccctcccacaacatgtgggaattacaggagctacaatgcaagatgagatttgggtgggggcgcagccaaaccatatcatgtgggaaatgtctttgcaccttcgagtttttttttctttcaaccacgtcatcatccttattattaccttccactggacctgaaatcattttgttctactcatgatgaacttgggtaccagcataatttagagttgctctctccactttcaaggctcatcgtcttcctgacgacatcagtatatgtgtggaaagcgcctggatagttttttcacctcaccacttccaaaggtcacacctctgtttactactctggttacatggatgttgtaatatctcacaactgttctaactttatgcatatgtatcatacttcccaagtataaacctatcttcttctactatactcattttgcttagatcatccagtaacttcatggagagctccaatccatcaaaccatctgtctttagctagttcatcaacttgcttatcatcaaatgaaatcaaaatttgatttcattgtgataacttttgttatacaattgctgtttccataaactctttactgacttttattctatccactttttctgggcttaaattaaaaaaaaaatactgtttttttttttttttaaatcacaccacatgatagattttgatcactagaaattcagggttatcaatttcaattgggtccaaatataactggaaattctactactatatttttctgttcagttatctttgttcttctactctgtatttcaactcctttcaattttctccagacttcaaccactccttcttttcactagcctattacttatagctgagaaaattgtagtcatataatggaaacttctttggctaccagtcctagaaattacatttttatgcatcttctcatttcctcttactataaaaaaaggcagagagagcctgtcttacagcctgtgatttggattttatcctgtttcacactaacagttatcacttctttcatgtgtatacacaaatactcgctaccaaattgaattatcctcaatatctaaacaagtttaagtgtttcttaccttaaaagtaataagaaaaattttttgaaagttgaacctttccttgatcccatatctttttctatccttagtcaaatttttctttatccattcagacaaacttcctataaagcattcttaaccttggtgtctctgtgctttcactgtgttcttcattgtccaatatagtttccacttccattcttcatacagaccgctctttctttgggcacttctgatctcaatggcacaaataaggggcatttccaataaccattttatgtagtatttggccagtattgggttcctgacatctcttctcctttagatactcttttattaataagcttttgtgatgccatgtacttccattttccttttgtagttctatatacttaaatatatttttttcatttccctctgtcctcattgtagcctcatcttcctcaatcttatcagagttgaaagtatagggcaaagagagtgaaagattgaggacacatcttgtggaactacaatgtttaaggttcacatggtagaattcaattttatgtgatgatgttttatatatatgcacatatatgtaatgtgtatatacacacagatgtatatagtcttgttatcatttgttgaatgtctactttgtgatagacagtatttgagctttaaggacacaaagttaactacagttcctaaattggaggtcacaccttgtcataacagataaagatacatgtgctttactggtactcatagggttggatctgcagtgtcattctatctttgtgtgtgttacagatgcctattttattcgttactgaaatttgggcataaatatttagaaataggttttgatttgggcacatttgttctttgaaggcagatgtgtgatttattctgaacgttagcaaaatttaatgtttaaatattaaaataaaaaacatgaatttaaggaggtttataggaataaaatactagtttattcatgtttttccaaactgggattggggggttaggtttttagtggagggagaagggaatggaagaaatataattttagtacatgtgtcttttatggctattttctgctcataaaagtggtgccacttaacatagcatgcttactgtgtggcaggagatgtgctaaatgttttatgtgcattatctcatttaatcttccctataaactttcctttatagaagaagaaattgaagttttcattttacataagttaaagttacagttaaagggtacgaactaggccaggtgtggtggctcatgcctgtaatcccagcagtttgggaggctgaggcaggcagatcacttgaggctaggagttcgagaccagcctagccaacatgttaaaaccccgtctctacaaaaatacaaaaattagccaggcgtggtggcatgtgcctataattccaactactggggaggctgaagcacgagaattgtttgaacctgggaggcagaggttagggtgagcccagatcatgccactgcactccagcctgtgtgacagaccaagaatctgtctcattaaaaaaaagaaaaagaatatgagttaaatatatatctgactttggagcctgggctcttaacactatgatatattgaaagaatattaaggggaaatttttttcagatttttctagtatctgtaatatcttgtattacatattgcatatattaattaatcatttcacatataccattcagtcttcacaagaaacccgtgatgtacggaaaggcagtattgtcaagatgagactacagagacccgagttaaatattaataacttgcttgggttacacgtgatagtagatcccaggcttccaaacacccagttcagctttccattataggagacacttcctgtggattcattcagtttgctagaggaaaaagttgtccttgttctctagggtttcccatctcccccaagtttaattcaactttatttcacttatttagttaataatccaggactgttgctggagtagcaaaaatttgattagaatcatcaccttcagtgtttcaggtaatggagtggagtaaaaatggcttagaaagcagagcctgttcattctgctcccaggctggcctcctggaaggtttaaagttgacatctggtatggctttcattgctctcttcttctgggaagcctggttgactgcttgacatcaagcattagatctgacctgagcattagcccaagcacgctttgcgtaattaagctattgagatttgttttccctgacaggacagaagagccctacaaggtgagggctctgttgaagtgataaagctgattagatctttagcagtaaaggaatctgatcttagaaatttcttctagctctcgttaatgaggcaaagacaacatttagcagggaaaatgaggtcactaaaaagaggaactttttttttttttaaataaagaaccaattattttgcctccttttaaatcaaggcctcaatttattgtcctgagtaaagctcaatttaaatgaacacatatgaaactttttctcaggggtgtagtaatcttgtttaaagtacaagaagttaaacaactcaagaaagtgaagctaagatagacctagaaattaaaataatttaatgaatactgacaacaaaactgaaataaccaacaatgatgtgtatttattcattagaatgtcattgttttcaaaaaaatgatttttaaaaactttttttctgtaacttctctttccttaaaccacaaacaagcaaataaaacttattttcctaggatacatttatacagacttcaggtattacactgttgacaatcacaccttttagtttagatagcacctttctatatgctgctatttaatccttagaaaactttttttgaaagctgtattatattcatattatggggttaagacttagctctaaaagtttcaaatctcaaatttatgtgaatcctcaagaatttgtaaacaagagggcttggagtataatacagggtttttttcacccctgagaaagtggtctgtaccagagttgtctcaagttatacattatttaaagtttttaatactattttctatttcttgctaagcccttgttccagtatttacaaaatgacatgggaattatgttcccaccaaatacatttatgtgaaatgtaaatcatatgcacacacatattgcacaccctcctgtgttcatagatggccacccttccatcatgaagcattctgcttaccacaaagaccccatcctccatctcactttcagcttattccagtaaaatcaattgtcacaaagggtaaacttggagtagaaaagaagtaatgcaggtagtttatgattgggacagatggaagggagatgagccatccattccagcggcttaccttatctcattgttattgactttgaggtggttgtagtgtgagaatggaaagggtttaatggaaccatgctgccatcttgtcaatataatgtctagtcagtgtgctagttaaaatgaaattcattttttaaatttaaaatttacttaacattttagacttttaaaggaaatttaaactctaaagtctacttaaatgaaatactctgtgtcttctttttcttgagaagcaatgtagtaaagttttcaaaagcaacctagaggcaggatgactcaggccattcccggcttcaccacttgttagcttttgtgccttggttcaattacttttctttaaaatgaacatgaaaataatacctacctcgtgtgattgtaatgaggattaaatcaatttatgtgtgtgtatgtgtgtgactgtagcttgggacagtctactttatatagtaagtgcttgacaaatgtaacttattatcagcccagtcaatcaaacttctcctcctccaccagagtaaaaatgtcctggcagagtttaccaaatacctaagagctaaccccaagtgatgcttattagtttcagtttctcttgacctctttcttatgttagatattatttgcctttacctaggtctttttggaaaactcagcctcccaaattttcaagttgttgttctatttctgcagaactgcaccaagctttcacagttttcacctcctcctgctagaggttttcacctcctcctactagaggttttcagtctgtactaagctagaaccatagcctgatctcagaattggcagatactcccatgggaaagaataaaatggctggagattattagataacatcagagacgctctcaccttctaaaatgtgtgtgcatctagatgccactgtttacacacgtatctgaaatctttaaattattgttattgtaatatgcctggcctttcctaatccttttattaggagtgttgacctgcttgaaacctcctggtaccaccaccctttctttcttaaccattcgatgttggctttatatccgctggtggccttttcagtcttgactttcatttccagtagttttcttctcttatttatcttcttatgccatcttactcaccaatcactttaactttcaaattagtcgcttattcccttccatggagttatctgatatccttcgtcagataacttcgaaatttatacctttattttaccctgataatcttctcttccaaatctatctatctagttattacttaagcattttccactgtgtgttatcataggcaaatcaaatttgaaatgttcaaaacatacttcattattttctccctcaatttgtttccttttctgtatcactagtcctgagaaggaatcctgacagcatcattcacctagtagtctaagccagaaatcattgagttgtcctatatttcacaactgagtcagtaagttctaccttctctgcttccttagtattatttttatctttcctttttcttctcatctcaccattcccactacttctagcatattgacttattttttctctccatatcatctttcactttatagccaaatatgtttctattagaccaatttgattatattctattcttactttaaacatcaactttcattacattttaaaaaatgctttgcaaatactccaaaataatgtatgtatccccatgaataaaggaatcaaatacaacattgaagagctgaatgctaaatctgttttctcttgaaagtcacagcacacattattattgttatttttttttagagtcagggtcttgctctgtcgctcaggctggagtgcggtggtgtcatcctacctcactgcagccttgaactcctgggttcaagcaattctcccaccttagtctcttagtctgtgaagtagctgatactataggcatgtgtcaccacacccagctaatctttttcttttcttttcttttctttttttttttttttttttttttttagcgacaggctctcactgtgttccctaggctggtcttgaacttctgggctcaagtactcctcctgcctcagcctcccaaagtgttaggattataggtgtgagttaccgcacccagccacagcacacattaaaagaaaggccatatcaagctttgctattgactataactacaaaactgtaaaatgagcttatatttaaatctagaaactttttttttcttaacattcttggatataaaactattgagtgctgtactcctgacctcaccctcatggtatttaaggccttccatgcctatgtctctaatctcatctcttcccttttgagcctttgtagccatagagattatatttatttagttttccaaacatgccatcccaatctttttcattgtatttgttcctttggcctggaacatcaataatctgttggttgacactcatccttgaaaattcagctgtttaaaactcagattatcttactaatgtgttcagtggttcacatactgcttggcacatagtaggtgctccatgtatgttaagtaaacaacaaaaatggaaaaaatcaatatgcgaaagtttacctttaaagagattttctatgtctgcctatatattgcctattcaggatatataacaatacttggtaataactgcttaaaaaatttaagctgcttaacctctgtaacgtaatttttcttcaaattttatattttgatttgtttacctgtacaagagttaggaaattacttacattataaggttaaatttttaattcttactgaacaaaaattagatttacttttgcatatatttagctattcccctccactgtagaaattccttgaaaactattgttgtaaatattttctgtttctttttgacaggtaatatttgaagctgaagtctcaggagggagaagtggttatattgccattgatgacatccaagtactgagttatccttgtggtaggttgtgattaagaattgtatttttctatgtcctttccacacttgccttatattggcagtgactattgattgtttatcacttggtttttgctgtctctcttgttattgttagtcctagccttctattgagttttaaaaggaaactgatatctttctagagtttttgaatcaaatatttttcaaacttgtaactaattgtatacctattaggagattcttttaaattatttcattactgagaacaaaatatacatgcaaaggcagctgttagtaggacttgttcatttttttggcatcattaaattgtctagaaaaacagagaagaatagcaaatcagagttcaacagaaaggaaaatataaagaagcctcatgaagttatttgatctgagttgagggctggggtgaaatgaagagaaataattagttcaccttattccaaatttaggactactttttttctcctctgtcataataaatgtctggctaactcatgaggtcaggagtttgagaccagtctggccaaaatggtgaaaccctatctctacttacaaaaaaaaaaaaaaaaaaattagccaggcgtggtggtgcacacctgtaatcccagctactcaggaggctgaggcaggacaatcacttgaacctgggaggtggaggttgcactgagctgagattgcaccactgcactccagcctgggcaaccacagcaagactccgtctcaaaaaaaaaaaaaaaaagaaagcaaacaaaacaagaaactcggtttattaatacacagttttgttatgcccttagaggcacattgattggttttcagatggtgtacctaaatttgtgtttacatcacagtccatgaaaaacaattactgcatgcattcagtagagccaggcaaaaaacagctggcataaattcagactttgcctatatttcccaaaagcagcattttatagggcccgtgaattctgggttatctgttcagcaatcctccctgagaagcatctataacacattgtaagcagcaggctggggcctcttgtgagggccaagacctgtgctcctgctgagtggttgtcaaactctagtgtgcttcggaatcacctacagctgtggtaaatcacagattgcttggctcttcccctggttctgattgaataggtctggggtggggcctgacaatttgcatttctgattccagtgcagctgatgttgctggtctagagttcgtaaattgagaactgctgctttagttcatgttctaactcaagaattccttattttaaatctcttcctgagaggtaagtcactagagaaagatgtagccagtaagggtcagattatatataccacgtggtggttggtaaattctaagaaaagagagaacaaaatcatctcatttaaagttcaagctgccttactaagttctttcaatctgtagtttaagagagctgtgtttttatctactgtttatttttcacttcttgaatgataggtgttaaggaaaggctttcataagtgcacagaaaatggtggattgagcacaacagcagttttagggtgatacggccctccatgaacttttctttttactcatgagccttagcttttgctgtttatataaatttcctttcaatgggaaacatggatgaggcttcagttttaaaaggtagtttcagaggatacttgtcagtcataaatcttacttatattttgactgcagtcattatttttgttagtctaatatgggtatttattttggattactatactatggttataatggaatagaaaaaaagtttaccagtttagctggtgttctttttctgagaagcaaaaatattcccttgttctttgaagtgctgtagagggttataactattgatgttttttttaaaaaaagatctaactgcttaaaatgtagcctaataagttcaatggccgtgtcactgccagtagtttagaaatcattatatgttttcattatatctttatattaggttctgatttcatgtcaatttaatctcttttggttgctttgacttgtaagtttgtaactgttttattatcatccatatacaacatgctatggcagcagttcagcagcaattgttgagtgctcactctgtagagaacaatactccagcaattatggaacagtaagtaatagagctattgagaaaaagagaactatgagagtcacagaggaaatggtgtcttccggcacaaaaaaagcccctcagttttcttctttctgatgttagtcttggccaaaggtaaaaacactaatgataatattcagctggagaaaagtaacatggcatattttcttcatgtgaaaacaaatacatttttttttcccttccttcacagataaatctcctcatttcctccgtctaggggatgtagaggtgaatgcagggcaaaacgctacatttcagtgcattgccacagggagagatgctgtgcataacaagttatggctccaggtaaggccaagttggcagctgagctaaagagtatactttatgttttaaaaacattgcaacaggactgtttgttgtctcatccttttgagtgtgtgtgtgtgtgcgtgtgcacacgcatgtagtgggacaggctgtctgcgtgagtttaattacagattcatgttagagatttccttttctgaaataaaacacatgagcaaataattaataagtatttttgttaggatctggtgaaacacaattctctctgttatattcaaactgcaaaaaattctgtagatccatttgaaatatgaataagaatgatattttttcttatttaataatatttttaaaactgaatttacaagagttaagtaggagctgtcatactctgataaattctttaaagtattttaagaaacccttgggaatatttcaggaagtatgaattggaagagagccaattaaatttttgagtttgagggttaatcacagatctgaggtgaagacatttgcctttcacatattacttccttaatacatttgtatttaattatgatttaacatacatgttggggaactgtaaatggtgcatataaacagatttaaaagaatctgagataaaactatagactaagaaatatgccttgccttcagagaatttatagaaagtctatctgtcagtgctagggtgctaggggctgggaggagctgagagcagctctaaagccaggaagctggacctaaaacagatggctattgagcgaagtatttgaagctagatgatgtgtaagtaataatattctctgagcacctctattattattttttaggttctctgcatcagaatgaggaaagagatttaataagttgtgaattttaaattcatgagaatgccaatagagaccaaaaaaaaaaaaaaaaaaacaagatgagtttaatttcttcaacataggcatcatgattttttttttactacatcctttagataggtgaaagtagtgttggggataactattagtttgcaggtggttgtaataaaggttataataaatgaatattgaaataataccttgtataatgactgatatgctgggtgttatatttgtgttatttcatcaagttcttccagcattccaattggaggttacaacaggtgtacttcatattaatctaattattactacttttatagcttatttgattttcaagtgtcaggataccatattttgtgtccaaatatgaaaaggagatgagggtcccttttttctgtgattatggtaatttctcctacagagattgaaaaataggataatttttcctggaaagcatgttgtataatgtgcaacctgttttatcaaataaatgtcaagtcagttttcttatttctcttcctatgcctaaataatagtttaaaaatgattttagatatatgttctaatcgttttgctagtgattttttcatttagatgggaacattagctggcatttggctttagttgtgagctatatagtcttttcttggagatctagaggctctgtaggtctgcccttggttttatgcctcaggatttaatgtgacattgaaataaaaagggttttgtatcctcagtcaccagctgccttgtggcaacaaagactttctggaccctgctggtctgagtgggtggtagtcccaatactgctcattttttttttttgtttgctttctattttgtagatagtccatttcatgatggttttaaaaaatgttcctcctgccatttttgtagcaaagatgagaggtaaaatattctatgaaacttctatgttgctttctcccctacctcacctcttttttttttcttttctttttttttttttttttggcgtttgctacagaatggtgaatttatgtatttctcttccactttgacatggacattgcctcattcttcagtagtgtgcatattcaccttaatttattcaaaagctattttacctttttcaataacaccacatcaattaccttaacttattcacttacatcagtcttccccatctacaagaaatattgaaatctattaattactaagggtgttttcaaattaaaataaaaacttttattatgaaattatttaaaaatgaaccagataagattgatcattatctatatatcaatcaattagaaggtggcagtgacttaaaaaacttgctcaacttttgccaaaagtaaaaaaaaacataataaagcaggaagaattctggttccaaagtgaatctaccagctaactcatgcaaacagatgtcagattattttcatttcacgtagaataacagcctagagttcaagaagctcagttctgaattctaacttttactctaaccctcctaaaccttttaacccagttaattgcagtggccttagagatttcatttatgtgttctgggcctcaatttgcttatttataaaaggagattctgaatagacactaaaatcccttccagctgtaagatgctaaactaggtctttacgttatttttggtggcttgaaacatggccttgataacctttttgtgtggaagatgaaaaagtcttgtaattcgttttgcatggggaaaaatggtacctttaagtatcattgtgagaacaaatgctcaaaatatctgctgctagtactgagaatgaatgtacttgaagcactcaatgaaaggtcactgcagtctatccacagaggtaatggaataatacaacagttgttatacctgccatggtcaggtaaaataccaaatggcaatcaactttatatgtcctccaaataacttacattatgtagtattgagcttcaattggcaaaatgttgtctaaatatgggctaaagtaacaaagactagaaaaacagccaattttctatttcaaaggaaaaatgatatactataactctgtgaaaggtgtacagaacacaatgcttgatcatatttgatattttaaataatttgttatggaaaaactgaaaaatttctctcacttctgtattctttctaggttataattaatatatcagtcgtttttgttgtctaaaataatatacaaattgagtaaattgaaaaatgcagggaaaaacacaaacaatgaattgcctgagttaatctaggataatttcataatgcatatcatggtagttctgaaagtatctatagggaatgttctttcttgtaagaattggattatataattgtagagtatttgaagtagatctaccttcttgtacatgctaaatgaactaatgatacataaaacaacatcgaatgtttttataagcctgagtgtcagtagactaaaaatatggtgaaatcatgaggttttctggaaagtagtttttaaaaatatgttatgcggtacatttatgcactaaaagaaatttagggtcgggcgcagtggctcacgcctgtaatcccagcactttgggacgccgaggtgggtggatcatgaggtcaggagttggagaccagcctggccaatatagtgaaaccctgtctctactaaaaatacaaaaattagccgggcgtggtggtgcgcgcatctagtcccagctactcggcaggctgaggcagaagaattgcttgaacccgggaggcggaggttgcagtgagctgagatcatgccactgcactccagcctgggtgacagagcgagaatgtgtctcaaaaaaaaaaaaaaaaaaaaaaagaaatttagaataaagtctttagtcacccttagagaacttccagattatttttcaattgagagctcagtgaagtagcatgtattctggatataaacgcattttttggttaatgatttgtaaattttttccacatgaacagacattttttaaatcttctaagttttagaactaagccattttaattttgtagtagtgttctcctatccttgggggatacattccaaaaagcccagtggatgcctgaaaccacacatagtaccaaaccccacatatactgtttttttcctatatatacatacctatgatcaagtttaattaataaattagacacagtaagagattaacaataataaaatagagcaattataacaatatactgtaataaaagttatatgaatgtgagctcttgtagcatatctttgtactttactcaccctccttaggatgaagtgaaatgataaaataactcataatgagaataagtgaggtgaatgacataggcagtgtgatgtagcattaggctactattgtccttctgacaatatgtcagaaggaggttcatctgcttggggctatcctagatcattgagccatgacgattttgatggttgggatgtcagaaacacacaatgtcgatgactaacaagtgagggatggcacaagatttcatcacgctactcagagtggagtgcaatttaaaacctatgaatggtttatttctgaaatttttcatttaagattttcagactgtgattgacagaaggtaactgcaactgcccaaagtgcgaccttggataaggaaggatgtctgtattcctgaggaacgttcaatgatacggaatttgtgattcataacttgaagctatgataaagctctacttatgggaaataagatcaaaagtgaaattataacatataatttatactgaaatgaaataataaaaagcatttggttatattcttgagaagtgtcaaataattttcttacaggaaaaataaaaattagattgtacacttttataggttagaaatgttggttatttttaaattttgaattttttgaattatttattttcagtattattgaaaatatttaaaattcaaaacttttaaaaaatattcaaatatttcaatatttgcatgtttttaatattcttgaattatttttattttttaatatcaaattattatcaatacatactacttgtacatatttatggggtacatgtgatatttttggaacaagcatataatgtgtaatgatccaattagggtaattgatgtatccgtaaccttgagtatttattatttctttgtgttaaggacattccaattccactttttaagttattttgaaatatacaataaattgttaactatagtcaccctatggtgctactgaacactagattgtaactcttatgaacactggataaagtgattgcaggaaaaagtgaatatataagcaaaaaatgaacatatggtgtagcagttccattcctaagtatttgcccaagagaaattaagacatgtgcccacaaaaagacttgtacaagaatgcctataacagctttattcataataactgataattagaaaaaacctacatgtccatgaacaggataatagatagacaatttgtggctcattcaaacaatggaatactgcttagcaataaaagaatgaactgctgataatgcaacagcgtgaatggatctcagcaacattaggttttggaaagaggacagacacaaaaaggtcatatcctttataatttcatttacattaagtttcataagaaacaaaactaacctatggtgatagaaatcagaacacttgttgcctgtggggaataaggattaattggatgtgggcagggggaaattctctagggtaatgttaatgtcatatatattgactggggtcttgatctatgagtgtacagacatttgtcaaagattaagatctgtccaatttactaattatgtttacctgaataagacacaaatgaggaaaaaatgagtaagtgacacattttatcaaataacgaacttactggcagtgctaatcaagccatagatggtaatagcctacaggcattacttgcgtttttatccatcttgtccatttcaagtgatttgattacattcaaaggtaatttgtaatcattagcctaacttgaaataaacatgttctgagtttctgctttaagaacaccttataacttgaggatatgaaagggttgtaactggggttggactgaaagttatgcattagtattctattatgaaggtccagtataagtggacacctacagggtaaatcaaatagagcctattgctgcaacatctgtcagaccatatgctttggcttcaagttcggtgtagaaactaaaatactaatgactccatccatcattacagcgcttggcaggcctgcatcattgaattgggcagagaaattcaacagtggagttattgaaagtagggaattgtgtgggtagatttggtggcaccatttgttttggtgaattgaaatgaggctgtttaatgtgtgactggtaatcctatgcagattgtcatcaaaactgtggcaattgggccaatctgtcagtaatcgccgcaggtgctggcactgtgcctcctccgtgggcctgccaaaacaggagagtcagccaccgcttcgcccttggtgaggctcatcattgctagaatagtgtgatacagctagttgctcagccaaaggaaatgtcattccttatggagcaacacataatttaagcaatggcttgagagtactaattggagagtgaaatcagtaaaatgagatgcaaattgctctcaaaaacaaccagagcgaggctgaccccctactgtaccaaccgttctcagtgaaggggcagtgaaagcggttggtctaaaacttctgaccacatagtgcgttacctgtccaggcaaattccaaagccttgttcctgtactccatgcaaacatcaccacatggtagtgggaatctaaagcatgatttctaaacaattgagttaattgggaagcacaaaaattttagctgatgaaaacatagcactacaccatttcagaggcctagtagttacggctcacagtgctctttctgatgaccccatgctatagcatttttctatgcttatttatattgccatttggcaagcccagatgtttgcagcatatttaatttctgcaagagattttactatcctgacactatttattttaggaaaaaaaagataattttccacttattataatgaaggtaagcttcctgaagaaattactgcatgcttaggaactgcagtttacagtaggcaattctttggaaactattttgagaggaggtttttaaagtcaacttgattaaatacataatatgtgatcagctcacgctaggtaacatgcataaagaaaaaacaatgcaatgcaatataataaaagttgctctaatgtctggacgtggtcaaagttctgacattttctaggtaaaagactttaagaatggctgacacacttctgaaatattaaaataacaaacagtagcatataagtaccaaaacagtgagtaaacttgaacaatgatgtcagaattgctaaaggcacatggcacaaatatatcttgagatttgtagaagattaggtaagtgacttatttactaccttgtaatgtaaggaatatacaaatggatttaatttcctccttatagatcctaaagtataataatgacatgatttgaagcttatggtgagagctataagctgattataagggagaactttgtaattgtagggctgttgaaaactacaatgagctgctccaggaggtagtaaaattacaattagtccaagtatccaagcataatctgggtaagcatatgctagagatgtagaagacatttgagcctgaggttaactactttttaagatactttttgccctgacatgtgattctataactgtgtatgggaagtctgtatagagtctaaggactgtactgtttcagagataagcgtgagcaacgcggactggagtatttggtgaaatcattagagaagacttgattgaaaccttgaagtgtacatagtacttgaataagcaaaagtgggcatggttactactgcagattcagaaggcagaaagcacgtcgtgtgtatgtgtggggacgtgggataggaaccgaaggagaaggatcttactgaagtggaaggttcaccatgaggagtggaggtaaatagaatttatggaaaagttggtactagaccacggtggagactgctggaagaggaagaggcttctgttctcagtacagtcatcagggaatgagggcctgattccggacagcgccattggcattggaagatccatgagtagcaaaggagaggacaaattaagaaacaaaacgattttgggcctggtttgcaccattttatagaatttgagaagatgtgagagtgaagtaatatagacagctttgtacattttctcagagtttatttttaaaagacagtcaatgagtttgttttttcaatttctagttttggagcgcatttgtctattagaaccattgttttactttttacctctttctaccttcataatttcatgtaagtgttcctcagtaggagtgaaaaatgaggagacatttcaattccttttgactctttctagctttaataaaagtttaccaagacaatttgaagcttgtcgccaacttaaacctctgagtggcccaggtgtcactgaggagaattaatctatgggaaaactgttggtgccttcaaccttggctgcttctgtaacttctggctcacaagacaggagtgtgaggagtgcaaaccatgtcccttgtgctttcctagtttcttgtcacctgctctaaactttagctgatagatgaatagtagcttgctatttaattctaattttctctgcttttgtctaagcagtagtgattttgccatgtatacactggtttacagttaattctgatccacttaagagaccgtgttctctttcgtagctaagagccaacactcggcagtcctgcttttcattgggccattggtatattctaattcacagcattatcttctttctgcatagctttatataaagaattctgcttataggtcttgagataaagtcaccgatctcatatcatggattataaggtttttcttctgctttctggcattttggatatgtaatgatgagcatcagaaagtttaatcatatttactttttagaattgttaaatactcctgaagtcattttggttgattttatgtggcttcctaccgtaaagagatcaatgccttgcagatataaagctttcttttccttctttaataatttataaactctgaatttaatgtttacagattacataactgatcataaatgaataatgcgtataatattctttaccttccttatctattcttggaacaggactatacaagcctggcagtcatggaagttcaaggattgctttttatcgatatctagaaataatttacttctctttctgtgcaagaacaatatgctctcctgtttgcagagctgccccttcagtgtgtttctaggtgtgtcacgtcaagcactttgtaactttcccattgagctcctgggatcagtattacaacatggatcactggcaggcctggtttcttctttatgaaaagtagtctgctagaaagatctaaaatttacaaaattattttattgtaaaataaaacgtaggtatagaataccacacaaaaataaaaactattgtgactcaatatcgggtaaacatcacacaggacaagaaagagagcttgccagccatcccagaggtgccgtccatgtgctctgtgccaggcataacagagctgtctccctgcctctacaaataaccactctcatgaattttaacccttgtagtttttttgcagttatatatgcatccctagacaccatagtcttaccagtttttaaaattagacatctttttaagtcacttttaatctgtaggtttgtcctttattcctttcctcgcaatttatctgttgagcctaggatgtttgacttctagcttcccctgtccacattttgctgattgcatactaatgccctcttcagttccacatgtccctctttcctctccatttcctgcaacttggcagccagatccagggtcaagtttgatcctttggcaacaccataggtggtgtttggtataataacaggaggaacaaaatgtgtcatctttctttttgtgatcttgtcagtctctgatgattaatgcctatatttattcctgggggtagaaaactgtgatattctatcatttttttgtgtgtcttatttcttttgtatttgtttagttgatgaaaagatacatactccccctaatctactatttggttacccaataacacaattcattaaggaaagggaaaatacatgctccaatctttgctatatttactagtttaaaatgagttggttccctatcatcctgcaaagatgacttactctttttttcttttaatatcattatacactcatggatttaaatatatttaatggagtttaatttgttgcaattattatttctattaaatcttaaatcgtcccatatttgcttagtgggcacctctccaaatttgctcctgattctttttgatatgattatagtaggctttgagagcttccttgctacctggtactgtgagatgtttcactttctcctctggatgtgagatcagtcatttttcaatgatgtcctgtttagttttagtaagaaatcatatttcaagataacgatgcaggttctgagagatactcatttctagatcgtttcagtgaatagagctaaaaaatacatacacatatatttaatgataaaatacctaatgagttcatagggatatttcaagttgaagcctaaaggtttttactcaatgtttatcttattacaacttttcagttacattttatttccacaccgatattcttggttgtcagtgacataaggaaggtggatttagaatatatcataattatacattggttttatctcattttattttgaaacttgtactaaagctccattgtcagcatatagctattgcatggataatatactttcttctacttagctcttatttagtctcacttctaaatgtaactatgtttttaatattcaatattagcccacctgtcatatctagtaattttgtacgtcagaaacaccttttttgcatttcaaattccttaggaactgctcatgggaatagtattccctgagttcttagatgttgataatagttttttgtgcccttgattcttaagtcaatttcacagtatatgaaatctttcattcacattttctttaattgagtaacttaaataatgttacttcattttctttcacagacagaataggtacagtcagtcactataaagccttggtgtctgtctgtacctattttttctagatatgcaaataattgtttctaattaatcttaccagaatatgtatcacagtaggtcactctgagatactgtcatcaggtatgtggtattttctttcattatgtagtttataaactttttttttattttagaaaattttttgttgttgttgttgtttttgcttttttttttttttgagatggagtctcactctgtcaccccagctggagtgtagtggcgcgatctccgctcactgcaagctccgcctcccgggttcacgccattctcctgcctcagcctcccgagtagctggaactacaggcgcccaccaccatgcccagctaaatttttttttttttttttttgtatttttagtagagatggggtttcaccatgttcaccaggatggtctcgatctcctgtcctcgtgatcaacctgcctcggcctcccaaagtgttgggattacaggcgtgagccaccgcacccagaagttttttaaaaaactatgatttgtagtactttatctgtacccttgatcctgtagagacttctgttttctctgtttgatctttgcctgtcatcattgatcactttcaaatatttttattctccttattctaaacattaaaaattacccctttttcactcattattcaggaatcatctgttgactttactgtagttactcataatttcttttttttccctctctatttctttctttctttttttttttaattagactttaagttctggggtacatgtgcaaaacatacaggtttgttacataggtatacacgtgccatggtggtttgctgcactcatcaacccatcacctacattaggtatttctcctaatgttctctctcccctagccccctatcccctgacaggccccagtgtgtgatgttcccctccctatgtccatgtgttctcattgtttgtctcccacttatgagtgagaactcataatttctagtaattaataatgatatttctttaatttctaattttccttaattgtcatttcatttctgagttttgttgtttaagtttatattgtttcatctcatgaatcatttccgtaatatgttttagcttatcttgaaatattatgttgcggttttgatctgttttatggacatatttttctgactgactttcattgacactaagaattatactctgttccttattttcttttaatcttacaaaatctatatgtggggtttgatcttgatacttttaagttattcatttttatgtgaaataagttttcctgaagttttaaaatgaggtggggttcaggaaactttacctgattttacagatttccctcttctgttgctttgagttatgttttaaaatacggcagcttgccttttgggatttctgggatttccccacttttgtctagtccttctatttccatactctcttattagtcagtctgtttttatgtggcaggttcagaaagattaaaaaactacgctactgccatcagcttcccagaatccctcagatctggtggtttcattgcatttgtcttctgacttcacccaccttccctctcactctataaattgcatggttttatagttgtggactcatatgcatcacgtttccactttctacagtgccgtttgaagcaaccagccaatcccattatgtttctttgtttgtttctttgttcttgtttctttgtttgactaaaatgttctaaggtagcaaatacatggttaccaaaactttgccttccatagatacttgattaggagtatatctaagagtgatattttacatgcctctactgctgcatcatgtagtggactagtagtgtcttctttgccactggcaagagaggttataagtacctttaaatctaatcagactgaaaaataaatttcagtaaacccagaatcagaaccaaatcagaaagttcatccataaaaatctgattctctagaagcacttctggtcctaaaatcatctctgtccctctggcctcaagaaagtaaagcagaaccagtaggagatagatatgattttattgaaatatatatatatatatatatatatatatatatatatatgtctatataattataagattacatatagtaggattttatttacaaaattgaagagatttactgcaaggaattggtttatgtgcttgtgcagattggctaggcaagtctgaagtctgtagggcaagcccttggggagggcaggctaaaacatgcatgcacagactgaagctgttgttcactggtagaatttcttctacttcggagaagcctcacccctggtcttaaagcctttcaactgattcaatccagtccactcagactatctaggataatcttatttactagattatggattttaagtccattcacaaaatgccttcacaaggtcacctagtttagtatttaatgaaataactggagattgtagcataggcaagtacacacatcaaaagactgacacagttatcaaacagattatttgcttagatattgtttggattatcatcttcataatattgtgattatcagaatttgctatgaatacctttgcacagcaatctcacagagtattctcatcatctctgttgaataagttggtacaaatacatatacccaatgttagatgaaaaggtagagatttgagaagtaatgagaaattgttcagctcacaaatggttacttcagggctagaagctgggtatcatccccagcagacatggttctgtcacttacacctgctctgtccgtgtggctcctcttattggtcaccttttctctccattgcaaagatactcatgcttcctagggtgaaactctttttcttgttgaatagctgactttatattttgttacacttgattaatctgattctagtatttgctatctccagcacatctttaccctgctttatttcagaattataatattcaccacctctttctctctctgtcaaatggtattcatttaccttcttccatccttccattgccagatagtcaatagtttgaatttattgtcatttcagcatattttttttttctaggagaacactatttacttactctaatgaaataagtataataatttctatggccataaataagaaacagtgcttctctcaaaataataacatagtattttttaattttagaaatttctaaatttaagttttctgtgaaatactttcatgtttttaaaattgtctttaaaatgatttcatgtttttggaattatagaattattttgttcttcaataatggtgattgtgatgatgatagtatctttatcatcctgtgagactgaaaaaaattcatacaaatcttataaagcagacaagctctagtaaggaactctcagttccttgggattaatttggctggaatgttgtaaatttcacgtcagcctcacttggtcgtagttgtgcaaattcactttggaattcattttgacaactcatatgcagtcttcttgatgctgttcaacagggacctaaatatcaaacataagaaaataggctctttctgagtcctacaattttaagaagatgagagaatcatatatcattatgtcaatgacatatgatagtcaatgatatatgaaagtcaatgaagaaataaatatataaataaatgtaatttgattattttcaagtcaatagccttgaaataatctcgacatgtattgtcagtgcagctctttttagtctgaaatgaaactggattgattttattcctcaaactttgaaaagagactctgaagtaaagtgtaacatattttaattataccatatttcttttaggatactttcaagctgaaagtaatagaaaaccaaatgtattatttcatttaacaaaaagtccaaagagaattgggctctagtaattgttggtgtcatttcagagatttgataagtaacttcctctgtctctctgcctgatatgccatcctgagtgcatcagcatttcccttagactggactgccttatggtgatgaatcagctcttccaggttttggcatgacagtaagaaaaagcaaagggaacccattttcttatgtctccttagaagtgaggaaacctttttagaaataacttgaccaattcctatcatatctccttggccagaatatggaccgataccccattttaaaaacatgtcactgttaatggaaagaagactcaggttaacctagtgttaatggcccagtgtgtctccacgtgtaatatcttgatgcagattttgatacaatatatctaaagtgatctcttgactcttcatttgtaacaatctgccagttgatgctgatgctactggtctgtagaccacatggcaaggtgtttggttaatagcctggctggtgaaaatagatgttggagaatcaacctttattaccactatattccaccaggaatgaaacttgtcaaatgaatactgcatgcactgtgcatgatgaagctgacttagtatagtagaggagaggagtgataacattgaggattatagtgacttgcccagggttacttggtaagtgacaagttttatccagcaacttgtattggagacaaaataaatacagaagcctgagatggattggagggcgggatggaaagcaggtaaaaaaagtagtgctaggttataatcccttggatcatatatttgtgtgattcatttttcagtacttctcagaggtgggtatacatttgcaatggagaaatcatatataaaaactcaaagcagaataaagagcctataaaaggaaaagttatttttgacttctagaatttaaatgttttcaattgttacctttagctctaatgaatcgttggaagccaagtaaagaaagcaatgtctaatatagattatattagcccattggaacgatgccttgattaaacctcaatactaaataatcaatttgttggataggaactgtaaccaaaatgaacataacagctttggtttagtttagaggaaagtctgctgtattttaggtcatcaaacctagttttgaattttagtcctgctaacaggctatgtgcatcacatttctaatctttctgaactttaattggatatgactgtatcagaaaagttcataagagagagaagccacagaaccagtaacagctcacataatataaggtacatggaggtgcttattaaatgattattgaagataaacctgaatattatgactgttaattttgttattttatttcaagaaataaatatcacataagtcttttgtactcattaattatataatatacatcctatataagcatatgtatttatagttatattagtatattaatacacacacatataagcatcatgtaatatatcagcttggtgatatcttgcctggatgagtttaagtatacccctcagcctctctgagttgtggtataattatttctgaaatagcttggtgtcagtgatctcttggtgtccttgaaattcaatatttttgtaacctccctttattattaatttggattgatgattaatgtgtattttattataacttaataaaagcctaaggaggatttatgtgactcttgtctctaaaatgttcagtgaatttaattcattttaacaaagtacttgagccacccgctaaataaagataatatatattaaatattatggaggaaaaaatatatataaatgagacatgaaaccctaccttcagaatgatttcagtatacaaacagatgaaaagacattgataaatatatcatagtagaaaagatttaagatagaaaagtcagttaataagtttttataatcttttatagagtttttgaggcagtatccatgaccctgtcagcaggagtagaaagggaagagtatatatgagctgatggaatgcgaacttgaggcagaggggaaggagctagataccatagatcaggtcacgtggaaatcaagtaggaatgtctgcaagtttttaatctccatttttagataacacagacatttttcataagaacaaatgaccgatttctgcaaatgtcagtagttttagaatagttgataagatagtgcaaattcaatattggcaatgcataaacaatagaaagttgaaagaatctggagccctttcaggctagagaatgtctctttgaaatgactcctgtaaagataagggtcacaaaatgaggtctcactgccaatgtagaggattgaaggagtgagagactgaattgcacgggctgttatgattcgagaggaaactgtcacagcacaggaacttggatgttgtaaggtggtaagggaggctgttggggatcactgaggccaaagtgagtttgaggatcaatgggaatattcacaggactgggttagggaggataatttggtctgtgaatattcccagtgatgggaatgatatgtgggcaccctgcgaattccaaaagttgagaggtgattgagtgggaaagtggaagagttgtcttcaagttaggaaccaggaaaatggtagctgtccctgaaagagggtgtaaggtaccataaaatgtaccctcctttgagatagtagtgttgtgagaggaatgccaataaaggtgaaaagatggaataatgattattgagaaggaaacattaaggatactcagaatctcttcacaagagaagggttttgaaaggcatagtgtgagaagacttgagtgggtgtggacatgtgcaagagaatttggaagtcagtacaggcagtgggaattggctagtcgtgcagaagaactgagaaatacatatggcagggagcaaggagagagtttgagaacacacctggagagataagctagaggaagcccagataaggttgtataacaaaagtaagcagcgtggtgggccttccaattaggaagattgtatggaaatgatgtgctaattgaaaaaaacgcagtctgaggtttgcatgtataatttttttttttggtttatgtggtttgtagggaaagagttttggctgattttatggatttatatttttggatataagctgctttttcagttccttattatccaagggaatgagtgggggatcttgctgcaaaaatcctgaaataggttggtaagcagagaaaaattaacaaaagtaatgaataaaaaatagcaaaatcctgatttggatttgatgtccttaggtatttttgtatgcatatgcagaaacatatatgtatttactacataatatgcatatgcatgatttaagatatggagaaaggtatttaaagatacagtgtatttgggatttagaaaattattattattattattattttttttttttttgagacagaatcttgctctatcacccaggctggagtgcagtggcgtgatctcggctcactgcaaactccacctcctgggttcacaccattctcctgcctcagcctcccaagtagctgggattataggcacccgccaccgcgcctggctaattttttgtatttttagtacagacggggtttcaccatgttagccaggatggtcttgatctcctgacctcgtgatccagccgcctcggcctcacaaagtgctgggattacaggcgtgagccaccgcgcctggccaggatttagaaaattattaaagcaatagagtatcctctttattatttactctaaaaatataatttcaaatgtacaaaaaatcatagaaaacaataaaatagccattaatgtaccaccaccctaatttaatagaagttaacagtttatatttttgtctcatgtcatcttatccttaaggaatttttaaattaacatttaaacatgcatacatgtagtactaatcagtggaatgctggaaccaatgagtgccagaaatttgttaagttttcaggaactttgatatcacactgataaactgaagttgctatagtggagtatttacaccccagaaatggacaaatactacaaaatggcattttatgtttcttgttggagaactaacagttccaaattttaccaatacattgctggtttttccttgcctagtttaactgtcccatcgtatcttactgaatgaataaaattcagtttatttatttgctactcagaaatatttggatattttccatatttcacaatcacagataatttagagttcaacatcttgtacgtatctccttgatcccacatacactggtggttcaaatgtggaaacctagaagtagaattgccgggtcctgaggtttatgcatcctcaactttactagatagtaacaaatcattttctaaagtcactctagcagtttacacttccaacaggaatgttatcatttttgtttcccatatatagccctatgaagtgatatttcaagtaatatgaaagataccaggggtagttagaatttcaccaacaagaaatgaggttgtggatcatgaccaattctttctcagcgttgtgggttttctttgtcctttttgctgtctttgacatatagaagttttaaaatttagattgacaatctcatttcatggttgttagacatacactttctcttttttataccctattcacttttgattgagttatctttttttctaattgcatatagaagatctttacgtattctggctatttattccttgatgggtatttccttgacaaatgacttatcactatttgtgacttgttttttcccctttatatatgatgtctttgaacatatagaggttataaattttttatagttgaatttttttcagtcatttcctattagtttatacttattactcttgtctgggatatgctgatatcataaatatggcttccagtatttcattttgaaatttgacaggtatgctttcaaagtttaggctcttttgactaattctctaaaatgtataaattggctgtcattaatgccaaagagagagttgtttgcaaagagtacagattttggtttgactctaaattattcatcattagtttattatcattctgtggccagcacatgctacacatttggaatacagagatgcacaggcaatgctcttactcttctggtggggaaaaacatactacagcacaggcaatacagcataagggctaaaagaagcttgtatatattactctgagagcatgggggcaatgaatcatttgccttggacccattaactctcctgttaattcatttactctggtgtagtagcaatttatggagaactgagaattactaccatagtgtcagccctacaccttttagagcaggggtccccaacccccaggctgcaaactggtactggtctgtggcctgtcaggaacagggccacacagcaggaggtgagcagtgggtgagcaagcattgccacctgagctctgcctcctatcagatcagctgtggcattagattctcataggagcacgaactctactgtgaactgtgaatgcaagggatctaggctgtgagtgcctgtgagaatctaatgcctgatgatttgaggtggaacagtttcatcctgaaatcatcccctcattgttccatagaaaaattgtcttccaggaaactggtcttttgtgccgaaaaggttgaggaccactgctttcgaggataccagtatttacttacattcttttcctgattgacaatggaaaaaaattgtggctcttttgcaacaagaataatttatcacagatattgcttgctaagatgctttatagatttatgaaaatagtaagaacctgtttttaaagattggtttctgtttgcagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagaggtaaggtgaaattgttttcacttcacgaaattgcatggctttattagaacaaaagcaactctgtagatattttgattgatttttaaaccatagtgtttctgatgtcaagtcactataaaaaatatatcatcatacaatttctcagaatgtgtgaaggtgaaattaagactgtagtttgtaaagtttttgaagtttctagtaagtgtttgccattgaaagaaatctattttataatgctctaagtggactaaatatatcaaataccttattccacattgtcatcacctcgtttgtattttaactttagatctagttcttcccgtttaaaacagttctgcggatactacttttctttgaagcattgtggcaatgaagtcaaggtccaagtttctatttccatatagtcctacaaattttactggtatcaaaacccaatagtgaattttcactgatgcatgtctcttatagaatcttagaaagttagaactaccaaacagtcctcactaatattcttggatactaaagttactagaagaatgtcagggattatgacatatcagtacatatttgtagtgaatactggaaaagtacaagtgcaaaacacatattacattcatttaagatgtatagagtccctcttatattgtaagcactgttctaggttgtagatattggagatacgattgtaaatgtaatacaatgtccctacccacatggagcatcatattgaattatgttaggcagactatatagacaggtgttaaaaatgtagtatcaagtcatggtatgggctatgaaggaaaaatagacacaaaacgatggaaattgatattttagttaaggtgttctggaaccagtcttaaggttaccactctgagaaggtaacaactgagctgaaagcttaaaaataaaaatagagacttcagccatatgaaaatctagaggtaaagcagctccgttgagtaggatatcaagcatcaatcaatattgacacaaatgaaaataatcgtaacctgtttaagtctcttcgaggagaagtgtgagagactttagcaaaaatatctaaactggggctgagactgtaaaactatcatggaaggcatttgcaagtgagttttctttgagtaaggatctgaaggttgagagaaagttgcccaagtaggggtatggatgtagagtcaggggcaagagaaagaaacaccagcaagcagagaacacagcacatgccgaggcctacgggctggaaggagaatatgagatatgtccatattttataatgcttggcatcaaatatcttttacatatattattcaatattgtcttgtttttaatactttaacctttgatatttttaacgaaaagaaatttgaaattcacactttatgataatttacccagagcaaattaaatctaatgattgacagccagaatagaacccattgtttcttgattcttaatggtgagctcattcttttccactacagttttccctcgcattaccattattggatgatgcgatcaacctcttgtaaactttagtcttggaagactctatcactcattttttaaaaaaactttatagattaaatacgactattttcagtgtaacttgtctgatgtctccgtattcagctcatatcacctgcacaagttcatgagatcccagtttcaattaagaaaatatgatagtatttgacttccgtatttaggcagagaaacaatttatcacatgttcacacatgcatctttgttaagtcccattccagcatctctctcacctgagcctaattttgaaagcctgaaggtgtccttgggtaatcttcagggtgattaatatgctatggctacaggaacgtgggcgtgctattgaattatcatgctcactggatcttctttaccatatatgcgttcacaatttgcaaccagtgaaggagatggtatcttaatagtgtacctagaatgcttttgaataacagtgatgtataatacatagttatatatgttctatatagttatctatacatttttttccagaaaagtcactcttgatgtatttctcaaaagattgtagaagacctgtttatgcttttatccaggtgctccctttatatgtatagtttcttctttcatgcgaacattttctgcctgtttattttaaaagagaatcattttgtcattactggatctcttttgtttatcttaattgataagtagattttattattttatcaaagcctggttttccttacctggagacaactacattacaatgctcttccagcagtattacttgttaaattaataattatttcaataaaatttataagaaagaggatccttaaatttcattgaaaattttgaccttttttttttttttttatttttctgagacagaatctcgctctgtcacccaggttggaatgcagtggcaggatctcggcttactgccccctctgcctcctgggttcaagtgattctcgtgcctcaacctcccaagtagctgagactacagatgtgtgccaccgcacccagctaatttttgtatttttaatagagagggggtttctccatgttggccagactggtcttgaactcctgaccttgtgatccatccgtctcagcctcccaaagtgctgggattacaggcatgagccaccactcccggccttatttttcctttttttaaagaaagtcctgccataagttttgtgatttttatgttggaaaggttgagttgaaagatgatggcattttgaatttgttatccagaatctgctatcattttagaaatatattttgatagttttgacaattttatttttctttcaacacactttaggttgttctatatttaatacgtacaggtgatactttgcttgctgttttatttgaaaaccaatacagaggaataagttttcttgtttgtagagataaccaccaaataaatattactaaccaaaaacatactctcgggggtcagctgtcttggtgttgaaacagtgctgagaattaactgtgctgacaggtcctatctctcattggcacttttaaagctgacatcctgttacatggatacaaaagatggtaattttaaaggaaattttgggggcagtgatatgaatagtctttaataagagctggcatggtattgcctgttgtcaaagatgacccaagggtaagagtttattagtgcattttctcctaaactgaaagtgacagggcatgcttaaggcttttttgttgctgtttgttacaaatgaaaatttcattgcagaattttcatgctgaagagtattgatctatgttttcccacagccagaagaataaaaaaaagtatggagaaacagaaattactttgctatgactttagcattgcttcctgatcattttgaataacgataatgtattcagcttatggaggccaatctctattgacaaagaagtttttatagagatgagatgcagagcagatatttttgctcagtgttttacaaaattgaagtgtaaaaaatttgaaatacaagtcgaagtagtatttataagcttcaaactgaatgcaccaagcttcaaactgaaagcaccaactttgtaatctaattatgctacagattattttgccaatcctcacctcagctgtgatctcctccgtctgtttccatctgtctaaaccgaagacccacttacatctcgaaccagctgacctaagtaaaacttctataaaattctctgattcctacacctcacactcaatttctattgcaaattgttatagttttatatctatcatttttacctgtgaaactacagttacattttaagtacttcagtttgaaagcacagtttttggtttgtcattgttaatggcttgagttttaaattttagtgtcaattactagtcattatcaaaatgctctggacacagaagtatttagttaatattttagtctgttcctaatgaataatagtgacctctagctataaatgggggttagtatcaatcactttacctaaccttactcagggtagttacccaaccttattcagagttggtgtttaacatcataagaaattcaaacagatgtcattccgttgtaagacaatataaactagcttatacataagaatatttactaatttttgtgactgggtagtacaggataggcttcaggatttgttgatcaagtcattaaagatccacgttctttccaattcttcactttgtagtctatgattttggcttctatcctaagccaggcctaccacctagtcttaggagagaaatatgactacatgcttccttggtcttatccagttagggataaagagggcagtacctaccacaactatcaaaataataataataataataataataatgcatcactggttattggataaacagctagtatgtccagtagagagcttttgtacacaggactccagagcgtaaacagtgttactcagaattagttgtttattttattcagataagatagtaactgaggaaataatgtcaagagaaggtacaacttaatcctgaaggacatacagagtttggaatatggtactattggagaagggtgttaccatactaagtcaagtaacagtatgaatcataggtaatcagtaggatcgtagcttatttggtcaatggtgaactgttcatggaatcacttgctttatgtcagttatttactatgcatatgaagaaggaaagcattcaaaacctattagaacttttcagattctgcttttactgtaattgtagtttatgtcctatcagagcctgtcttgttcatctttgtttgcttcagcacctagcacaatatttacatgaagaaattcagtacttttctcaaaatcaacaaataaaattgtttagttgaaatcagaggagtgggactgaccctggcatatgtaggggatgagcaatgaaccacatatttcttctcacctacagatggagtcaagtttgctggcataaaggaagtgatgatgacaattgtggtgtctacaccagactctttcctttgtcaagtgggttattaagggtgacttttcagtttggtgtaaatatttttcatttgaaaaataatattgatttgaccagtattctattccggtactctaatctttttgtacataaaattaaatctgaatttttttggtgtttttatataagaagcaaggttttgctagttggtggctaagggccatggaatttctagcttgagacctttagcaagctgtttaataccatgcagtattgatttttaactagtttccctagcacagcttttaggctcatgaattcatataaagatcctttttcttaatggtgacttgagatcccttttcttctattgtgaaaactggtcatcttgacaggaagtttggaattatcttggagaatgtaatttaaacagctatgttttctaaaaactgaaatataatgaacatttcagaacacactgaatcacatactaattttaccccccaaaacccctaaatatttaaaaaagcccatgcagccagtggataccaaatgtgtcaaatttggaggagtctccaaatctctcatatttaaaaattttactttgctccccttgagtatgataaaagaaacatttggagtctcctctcattcatattatctacttgtaattcaggtgattcagtgttcaagatgtctggtacatatttaaattctaaatgagcaaaagagtgctagatgttcttatttcagatagtatattttggtgcaaccagaaactagacactcatttgaattgttcatatagtccattaaacatacattttcaaagctgaaaagtattaaaaaaaagatagtatctatgtttatttaagagtagtagaaaaattatggcttttaaatctaatatgaatattgactgggacttcatataattactgaaactctacttgatccacttctgtacaccattatgccaaatacttttttctattaattttctccttttctgagtttccttatagctactccataaggatagtaaagtgcagcagttgtgtttgtcagattgatttttttcattttatttattttctttcagtttgtttttaaaataaaaatgcgatgagagttctttccctaaaggtttctcagtttattttcctaggcaatttgtgtgttgagtgggtagggtactggtcactgctctttggagtaaatattgggggtttgcttttgatgaagctttcgtcttaagaatttgaaaaggatcaaagaggaagcagaatcatttgcatcattaataattatttgtgctgaactcaagggaattttatttcagattgttgacagtaggcctgtacacgttttctaagtttcaattctcttctcttggagtttgtgataaatgtaatttggacccatttccgtctaccaagggactcctatctactacatggcccgagtgtcttcgtagtttatattcccctatctgttaatcatttttctttctcttaccccaaaccaaaaataaagaaacagtgtccatttgaactaagattttttagtctttctgggtttatttgcaacttcattgaaaaatcagctagcagcctttattgagttcttaatgaggtaataggcaagtgcatattatgatgttaagtattcaataaagacaaatgccaaaaaaatcgcatacatagtctcagtacttaagaatctcataatttaattctataggaaatgtagaattattgagtatcatgacacagaattttgacttaggttttgattttaaactctgtaagaataaaaaatgtttcctaacaaataaaaaatagtctacctattttctaactgcaatgaaatagcaactatttcattgaaaccccttattaagcactaatttggctttaaaaagttacactgggagagtcttatagaatgttaattgaacagaagctctatagttgacaaattggaatcaatcagtgagggcagggagataaatcagagtgtttagtggtataatgagtaaggatggcaatagaagtgttgtagtgggacattacttcattagtttgagttcttgagtctctcccactctcccctccacttcatcttcaagagagtcattaatagcagggttctctaccactatatgacttacaggtgagtttttgtgtttagtcttgcagttagcataaattatttgccacttaagcagtacatcttttaaaaagctagctaatatacattctgctgaccagtaaagcatgatcaggaacctgactgttactaagaatacaaacatggaaatatatagaaaacaaaaaaatgcataaaatgttatgtagaagccttacaaataaagcaaataataatatgtaattatttattaatgtgtcgatcaaaaccggcttgttcaaagtttatgatagtaccacagaaattgcttgctttcccatctgggttaagataaatgatgttttccctctttctaggaaataatataatctgacaagaattaaaaccaagtataaggtcaacacaaatgaatacagataaataatactttgtcactcctcagcatagattgtgtttagttcatgattattaatttttagaaaaaaagggaaatattgtaacatttcagtattaaaagtgagaatttggggacggagagctggacagaaattaaataatatggcagaaaatatggcggctttcctcaaatataaatatacaacagtctcttcttgtacaggctttactttagctctgatacttgtttttagagaaattatggcctatagatgtgttctcatctcttacaaggtatataaatacagtgacttttacactttaggatataatttatccttgttataggcacataactttcttttgctctccagtttctgttttctgagccctaaactgagaaaatattttgttgtttttctttattgttgcttgatttggagtcatagatttagctatgatgacacagaatctgtccttgtattaaacaacaaaacagcaagtaggtaattacttgtaccttcgttaggaagaaattttacccacctggttatttacgtattgctgattgcccctggattttcattagtcttttttatacatatggagataccatggctactctcatgttgccatgctacctcctccagcagcttcccttcacattaagggggaaaaaaaatcacagtcctttcctgttctaagtgaccttaaatgaaatatcccctgactgccactccaaatttgttctttatcactcacctccttccttgatccacagcaggcaaagccagctcttccgagtatacttctgtctctgggcattagacttcctgctctttccaccctcgcgtattttttcttgaatagatgcacgcttttacattcttattcctttcagctttcttcttattccccaccccccctccccaaaaatacctaaaggccaaatggcaattattttctagtacagaagagaattcattgattttgttttactgttttttttttttcctccggagttatttaggtcaaagtttttgaaagatctttatgtaatgcctactatcagtaagtatatgcataacaagagaatggtctcaaagatttttgtgctgttggaaatgcagtgaatagaaatctgtatgtctgaaatttgtttgtaatatgtatataaatagattccgttattcatattttattgcatagcctttgaatgccccacacttttctttattctcactgccaccacttgtctctgtcaccatcttctctttcgtgtacttctataaaaaacctacttattgatctccctccatgaacgcttaccttctccaaggcagtcttcacacagaagccagagtgactgtatgacacagtaagtcagaatatgctccccctggcactggcagcttcctgttcttgcggtataaattccagctgcctcatcacagctccaaggccctgcttgctcctaggcttttagctgggctcacccccttcagtccttcataagactctcctttgctcactaaactctagcaacactggttttctttcacttgctttaacataccatgatctctcatgccttagggtcttggctttttctaatcaccctgctccttcaaaatataactgcattcataacatctgtctcctccatgagactgatgtacttagggacccctttccttttgctcactcatgattggatctctgtagccaataccatgatcaaagtctagcaggtctcatcaaatattgtcaaaaaaacaaaaatagtgaggtataaagtgccatatgaatgacatgaatttaatgtgtagaatgaggagggcagcctcgtggctgccttttaatggtcaggggatgtgctgaggaggatgggaagttccatcggactcttgatgggtgggtagcatttggatagtggaagataagtaaagggcattctgggtagagggactggcactggaaaacatgttcttgtgaactagcagtaaatattgactgtaacacagtgttttccactgaaaacatctgagatgatcctgaaattgtactttgaggccttactgtggaacaatttgagtgccagactaagaaatataaatgcattgtgttatttaatttgggaacctttaggagttttgaagtaggttacttacatattatctgtctcagaaaaccaggataccagatgatgtggaaaatggcgcgtttttagggagtaagttaagggggctcttacaattttaaaaacttgagatgataagtgataagtgttcctggggggggtggttatggtagaaagaatgagtcaaggatgagagattaggcagcaatgttgttaaagcattgtgtaatgacagtaggaggagaagtcaaaggagacttctagatttttgtttgggatattggataaaatgtggtattatggtcagagatttggaagccttgtagaagaactcatttgagagcatagatgttaagtttaattgtaaactttcgattggggtgctaggaacatatccagttttaaaatctttaggaatgtgggtaagccttaaactaatcatagggcattaagtaaagactcaatacaggatgaattgaacaataggtgcttagtgcatagaaattatttgtatttcctaagtttccatttcatagcctttagcctatattattggaatttttcatgttgtttaactgtggatgaaagcacagttttttaactaaatggaaaatttagaaagagaaaccaggcagttaaatatgatgtcttttttattgctgacattatctgcatataaaaacacatgtaagatatatcatgtggaaagatatcccccactgcttcatgtagattcctgactgtattttggttgtcggttaagtggaaatctttttcctcttctttgtaaaactttttacttcatagaaataaagcaaactctctacaggcttctctactttctcttcagaattttattgctcctgataataatgctcctggacctttttcctacatcaatgttttaaagggttgggagagggaattttttttttttttttttgagggtgtaggacttttggctaacagcatttctcattctcaaagaatgtcattcactgtagtgggtggtttgaaaatatttacttaagggtagataaagagttcccacctgacataatcttcctgtgttaaaatccccactcaatttggcatttctgtgtactgtgcaggattgctaaaaagcagttaccatgatcagactggttgatgcatggtaaagatgtaaagcagggtgtttggaattcaacatggatggtagaaatgcgagatgtcagagaagccatatattaaagagaatttgaattggaaactgaatcccaatctgccaccgagaacattttgatcattttgatttattaaacttttataacaacattcagatggagctgaattaaaacctttagtcttggatagtttatgggacaccaaccactgtgttaccggtatcattttgaaggatctcttagcgtcagtgaaaaggggaaaaatgggtgggtaagatacttaatttaaaggaagttttcacttatattcttgcatctaactttaaatccctcttttgtttgcattgtgtcacttaaacatattttataatttcaacatattagataccttaaggttttgaattttattgtgaaacgtttttgaaattctgattaataattttcagattgaaacactgcttttgtatatatggtacaggctatcttttctttttgtgtatatctgtacactcagaggcatctgtatctgtctatgtttgtgttgctgaggtttatagataaatattcaaatagaaatactaatgcaattttgaagcctaacttgcatgtaaatgagtgcattttcctaaaactattgaattctgtacgtctgattttttaaaaatcaaccatcagcaatcatggatagtcttttctgaacagtagctccataataaagagaagtcaatcactattagagaagcactgtaggtgaaaggcactatagttcacacttgattttgtagcggggagagggtacttagctgtgaatcaggaatgatgcaaaagatggatgagatagagttcaaggagcagtaatgtgagagtccaggacaatcatttcaagctgtctcagcagtaatgatggatggcttggtggtaagaagtaataataccagatgatgaaagatgcatctcagcaccttgagcccgagcacaccatctacctgttggggttctggggcataatgattcctgatttgcaaccaaagggttttgctgcacttagcaacccagatttttggcagctgtgaaggaagcaagtagcatatcaaacactccttcacattgtaaatttaattacctcatatttatgcatagtagttgttgacaggaacttgtaagctatgctaatatggaaggtaatttgttacctccagaaatcactttccatgtgtcttctgatcattatcatgaaacatgataaatgatctagcccatgaggtataaatgaaaatgaaatagataattggattctatgtctacattgtggctggaatagtcacagcaattataattgaatttatctcataaaaatgagttggcaatacatcagtgacctttcatcattttgtgcctatggtattatatgaagctacttttgagatgaacacaaaaaatgtatcataattctttttaaagagtaatctctaacacttaaattttctattttcttgccttatctgcctatatatttttaagtatctagtttatctacagcgagttttaacaattaatactgataatcctttttttatactgagaataaagtgttttgttgttaccagtgccttgactgaatggcttaggaacagtgtaagacactctgattttttttttttttttttttaatgaacaccctttattattagcagcatgtatctttctgctgggtgatggaagtgtgccttcttgctgaatctgtgtgttctctttgattcttataatatgtttctgatatactaaaataaaagagtttgttttaaatatcaccagacttttttctctttaccttctctttaagtcactttaaataataatattttattattgacataaaaaccctatatattcattgatttgattaacatatttgaggatcaccatgtgttaattattggatttattgctaataaaatgactaagatgcatactctttagggggttatagtgccatatgtaactatggtaatatctagttttcaaattataacataatttcttttttctccaccagcctctttccatgagggtccaagaagcaaataaagcttctgtttatgtttttgtatttctaactaagaaagtctattccagattcagttactaacaactatatggaaaataagaagttatctggaaatgtgacttatcttttgaatgaaatatgtcaataagcagggcatgtccctagggacattttctcccactcttatattttttaacttgaattttttttttttttttttttttttttttggtctgtgatgcagattctcactgtgttgtccaggctagagttcagtggcacaatcttggctcactagaacctctgcctcccaggttcgagcaactctcctgcctccacctctcaagtaactgggattacaggtgccccccaccactcccaatttttgtgtatttttaatagagatggggtttcgccatattggccatgtttggtctcaaactcctgacctggacctcaaacaccatcctaagatggtgatccacccatcttagcctcccaaaatgctgggattataggcgtgagccaccacgcctggccttttcttgaaatttcttcactttctttccttttgtttttcttcaacttttaagttcaggggtacatgtgcaggatgtgcaggtttgttacatacataaatgtgtcccatggtggtttgctgcacagattgtcccatcacctaggtattaagctcagaatccattagccgctcttcctgatgctctccctcccccgcatacttccatccaacaggccccagtgtgtgttgttcccctccatgtatccatgtgttctcattattcagctatcacttataagtgcggaatgtggtgtttggttttctgttcttgcattagtttgctgaggataatagcttccaagtctctccatgtccctgcaaaggacatggtccaattcctttgtatggttgcatggtatttcatggtatacatgtaccacattttctttatccagtgggtcatttatgggcatctaggttgattgcatgtctttgctattgcgaatagtgctgcaatgaacacacacatgcatgtatctttataaaagaatgattccattcttttgggtatatacccagtagagggatttctgggtcaaatggtatttctgcctctaggtctctgaggaattgccacactgtcttccgcaagggttgagctaatttacattccaacagtttataagcattcctttttctccacacccttgccagcatctgttgtttttgactcttcgataatcaccattctgactgatatgagatggtatctctttgtggttttgatttgcattactctaatgatcagtgatgttgatcttttttttttttcatgtttgttggctgcctatatgtcttcttttgagaaatgtctgttcatgtcctttgcctactttttaatggagttgttttcttcttgtaaattcgcttaagttccttataaactctggatattagacttttgtcagatggatagattgcaaaaattttctcccattttgtaggttgtttgttcactctgatgttaatttcttttgctgtgcagaagttctttcgttagatcccatttgtcaatttttgcttttgttgagatttcttttggtgtcttcatcatgaaatctttatccatgcctatgtcctgaatggtattgcctagatttccttctaggctttttatagttttgagttttacatttaagtctttaatcatcttgggttaatttttgtatatgttttaaggaaggggtccagtttcaattttctgcatttggctagccagttctcccagcaccatttattaaatagggaatcctctccccattgcttgttttttcaggtttgtcaaagatcagatggttgtaggtggatagtcttatttttgaattctctattctgttccactggtctatgtgtttgttcttgtatcaatactatgctgttttggttactgtagccttatactgtagctagaagttgggtagtatgatgcctccagctttgttcattttgctttggattgtcttggctatttaggatcttttttggttccatatgaattttaaaatagtttttttctaattttatgaggaacatcaatagtagtctaatgggaatgctattgaatctataaattactttaggcagtatggccattttcatgacattgattcttcctgtccatgagcatggaatgtttcccatttgtttgtgtcctctctgatttcttggaggagtggtttgtagttttccttgaagaggtcttccacttcccttgttagctgtatttctaggcattttattctctttgtagcaattgtgaatgggagtttactcagaatttggctctgtgcttgcctcttgttggggtataggactgctagcaattttttcacattgattatcctgagactttgctgaagttgcttatcagcttaagaagcttttaggctgaggtgatggggttttctaggtataggatcatgtcatctgcaaataaagataattcaacttcctctcttcctattcaaatactctttatttctttgtcttgcctgattgccctggccagaactttcaatactatgttgaataggagtggtgagagatgacgtccttgtcttgtactggttttcaaggggaatgcttccagcttttgcccaatcagcatgatattgccgattttgcctgtgggtttgtcatatatggctgttactgttttgaagtcttttccattggtttattgagagtttttaacctgaagagatattgaattccattgaagtccttttctgcatctattgcgataatcatgtgtttttgtttttgtttttgtttttttgtctttagttctgtttatgtgatgaatcacatttatttatttgtgtatgttgaaccaaccttgcatcccggggaagaagccaacttgatcatggtggataagctttttgatatgctgctggattcggtttaacagtattttgttgaggatttttacatagatgttcattaaggatgttggcctgaagttttcttttgtctgttgtatctctgtcaagttttggtatttaggatgatgctggccttatagaaagaggtagggaagaatcccgccttcttaattttttggattagtttccgtagaaatggtaccagctcttctttgtacctctggtagaattcagctgtcaatccatctgatcctgggctttattttggtttgtaggctatttattagtgcctcaatttcagaatttgtcattggtctatccagggattctatttcaaattcaaattgagttgactgaaccacagagatggcaaccaccccttccctggggaactccgtccttcttaggtggacggagcctgtcagcctgtcagcactgtctggctggaattccaagccagttggtcttaacttgtgaagtgccctcgaagtggggcctgcagaacaacactgcttggctccctgtattcagccccgctcctaggagtatgtagtgaccctccctgggaatcccgggtccagagtatacaaaactcctgagtgtctgtgtgtacttaagtggttgctctgctgggacatcacacagctctgtgtattggacccaaggccctagtagcctgaacttacaaggggatctcctgatctgcaggttgcaaatatttacgggagaagcgtggtttccccggggcagggttacataattcctcaccgcttcccctggctgggagtggggcttcctttggcttcatgtctccccgaagtgggccatcgccccaccctgcttttcttcattttccgtgggttgagctgtttgcctagtcagtcccagtgtgagaacctggatatttcagtggaagatgctgaattcactctctgccttcgttcctctccttaagtgccacagatggcatctgcttttattcgtccattttccagggcctatatatcaatttcttcactttccatactcattggtagtgatactccaactaataagattattgttaattttattaatactagtcttgctacttgaagcaagttttacataaatatgaataagaaacagatttgtgagatttaccccttaaatttcaatgattcttactactgtgttactggggtcattatcttgtctctagaaacaatgcatttcctttaagttgcttgactgctatttttaactgattcctgccctaacaagtagcatgatagttattacctaccattttatttaatatttttaatttttaaaatttgatttagtaaaatatatatattttttaatagagatggggtctcactatgtttcccaggctattcttgaaatcctggcttcaagcagtcctcccatctcagcctcccaaagtgctgagattacacgcatgagccgtcacgcctggccaaacctatcattttatagtagattctcaatacaggaacaggagacgtgtgttcctttctaaatcaaatgtagtttatatttgaaactatttaggactaccacacatgtcctttttttagattctgatgtactactgtaaacatacgcacacactcatgcacactcacatgtgcatggatgtgcactcaaccttgatttcagcatggctttgttagaatctaggcagagcctggcataagtgtggtttattaaaagttaagaaattattctgctattgctcttgcatttttcttctcctcttccctgaacatttttcttggattttatgtcaagaattatgaattgcctttgtagcgctaagaaaattttggaagtgttttcaatgtctttaataatatcatgagattctttgagtttcagcactttcctgtttgtagaaaaaataaattacatagaatttaatagcctatcctcttttaaagtcatagtgcttagtaatcaaagaaagtccataagcacctatttttaattaatatgaaaattaaaaacaccttccagggtaggctcagtaaggtaggatcttttaatgtcccaatcatctttgattaagtccaatgaaaattttggactctctgtcccttcccttcccctccctccctccctccctccctccctccctccctccttccctcccttcttcctcctcaccctccccctcctcctccccccctcctcctcatccttcttcttcttcttcttcttctctctctctttctgtctttttttctttttcagaccactccattgacttctcattttcagcttgataaaatagcattagaaaacttttatttatttattttacttttgacagggtctctctctgtcacctagactggttcactacagcctcagcctcccagatacaagcaatctcacctcagcctcccaagtagctaagacgatagctgagcaccaccacactggctatttttaattttatctttatatttcatagagtcaggagtcttgctgtgttccccaggctggtcttgaatgcctggccttaagtgatcctcctgcctcagactctcaaattgctatgataataggtgtgagccctctgcctggcctagaaacctttaaatgtatgctgtggaggaagtttactctaatttgtatcttaagtagggatgtaatctaaatgtctcttcatgataaaagtcaaatcatgagctaaatccccttttaaatgactcatttgcagagtagctccatttctacatttgcttaccttacctagagagatgttattagatgagttcagaatttttctctgaactaacagtggcaatgcagagtacaaataatatcaagacattaaagacctaactttgcatgattccagtataatgttacataaaagaaatatattctcataatagagagatgctctgggaaatgtatgaaccatcatatatagatgaattcaaataagtaattctgaagaacttgtagttagaaagcagaaaaaagtttacttgatgcctttatgtggtataatcacatcacaatatatgtaacatacaaagatggctgtagaactccactgctccttctaacctatacttgatccatctcataggcagaagcatttgaatgcctaaacttttgcagatggctattcttcatgtttcttttgatttcggggattctcttgctttagaagtcaaaagatctggtacattgaagcatttaaggaaaaacatagacgcccatgtttgtgattgatttaggaattttcaagagaaattttgaaggaattagattttgccatacatgctggctttaaatgttaaatctcaggatgagattccacttctacttagtggcccttgcgggggttggcccttgtgggagttggtggattttctggttaagagtttagtttgtttcctccctttccctaccctttccctccctccctccctccctccctcccttccttccttgatatattgtaggcatatggaaaagtgtatattaaacatatagtttgataaatgtatatatagcttgttgaatattaccagcaccccagaagtgctacctcattccattctagttaataacctcttcccccagagtaaccactgttcttggtttataacattaataagtaacaggtatatggcatcttacatatgaatagtttatactcttatctggtttctctcattcagcattaagtttgtgaaatctgtattgctgcatgtagctatgcatcatagaacatcattgttatgaaatcttgttgtgtgactgtgccacaatttattcatttttctgatgatagacatttggttctttttcaccttgagctatttacaatagcagtatttgaatatactactatatgacttttcaggaacagatgggatcattttggggtagcacgtacctgaaagcggaattgctaggtcatagggtatgctgattttcagctcaaggaggtactggcaaaaaattttcttaatttctcatataatttatactccaccttgcaagcataaagtttcacatcttcaccaacagttgacattatcttgctttccatttctaattatcttcttatgttaatacttttatttgttcataagtgcattcattcaacaaatattgattgcactgaagacataaatgtaattcaaaggcaaacaatatacagtccttgccttcaagaaagtcagtaagtgaagagagaggcaaaaaatataggtaaatctcttaccagaaaaagtgcgtttatttcaggctgaagagagtgtagtgagaaaggttttcagaggcagtaataactgaactgaaatttgaagatagataactttgctaagtgtataaatggcaaaaagacactctaggaagtataggataaaggtggaatgatttttattattatactttaagttctggggtacttgtgcagaatgtgcagttttgttacataggtatacacatgccatggtggtttgctgcacccatcaacccatcacctacattaggtaattctcctaatgctatccctcccctagccccctacccccacaacaggccatggtgtataatgttcccctccctgtgtccatgtgttctcgttgttcaactcaaggtgggatgattttaagagaagagtttcccatggaaaacacaagttgttaaatgtgaacatataattggacttgaagagtgataacacatgaggctggacagatgagcaggggacagatcatgaaagggcagtgcatttattttaggaagtttgcatctttctcagaagtttactttcagctgtcttaataagacatagagttctatttatcacctgctgcatcataaaacttagtggcataaaacaataaccattttatagtgttcacagcttctgtgggctataaatttgggtgatatgtatagatcactccagtatgatatttgggtcccgagctgagagtctcaaattgaacagctaaaggtgatttaaactcctggaggctagaatcatctggcacaagtctggcacttgaattgggataatgccactggctaattgaaaattggaaatggtggcacctagaacaagtgttctaggtctcattacatcactttctctgcactatacttgttgaggcaggcatgaggtctctctggattgaaggggatccagcctctcaatgcgagtgctatcagagaatttgtagcgcattttcagaccattgcagtgactaatgttattttgtgcctttatttcatgttctttttgttgtctaccgtaatagtcacaaaaatctatctagtatagtttgattgtcccccctccccagccattctgagtgtaatttgaatatcacctaggggacaccttggtttagagagcacagtcttaaccattgatctctttttcctcacataattgacattggttttataaagaagaaaatatacaatgagtacatttatatctctgtttaacataatttgcatttatatattaaaataaattttgaaagtagatttcaaaatatccaggtacaaattagtgcctttatagtttaagcaaattattatgctgtatagtaatgatacatctagtatacttctctgattaatttccaagtttagtatcttgacatttgttcaatgtcagacttttaatttaaaacctggacatagacatttaaagatagctaatgcatgaggggcttaaaacccagatgacaggttgataggtgcagcaaaccaccgtggcacatgtatacctatgtaacaaacctgcatgttctgcacatgtatcctgaacttaaagtaaattttttaagccaaaaaaaaaaaaaagaaaaaaacaaaagagattaaaaaatgtaattgtatggcgctggagcaggaattgatacccttcagttacaatatggagatctctcagctatcaacttatattagtgcatcattttacaaaatttcataccaaagaaacatggtaccttcttcttttttctataatgtttaaaatagtagccttcctttctcaattctttattcgtcttacatccactgattgaggtaatattttcaggaatcttcaatatctatgaaaatattagtgccattttatgtcttatggttcttttctccagcaaattttcagctgacctggctgagcgtggaaaaggatagggaatttgaaatttacagaaaagagtatatgaatagtctggattggtagccattttatgtccttattttttaaaggcatggtatttatcaaagtagactaggaagctctcttgttacttaggaacagtagctgtgaaagaagaacccaactccttagctgtgtaattgcattacttgtgctctagaaactattttactagcctggaaatttctcttgctgtgcatgttggattatagaactaggactcccttccagtatttcatattttggatgatatgacttattttgatactatgaatgtcagatgccccattaaggtgtgaaagtgagtgtgttcaaggggagttgaaataaaaggtcttttgctggcttggctgtcacactggtataaaatgtctttgaacaggtaactatttttacatggttaagcatcttaaaaatattattaacttgttattttatcagatgggtctataattattgccaaccttcagcttccatctatttataaaactaggtgtggtgattttgatagcactttgattattgaggacaggtattttggcccctaaaggaatggtaatagaattagatgattaaaatattttttcagaagtccttatagtaaccatattgatagatctgctttaatgcattctcttttttcttcccccatcattaagcctacatattctccaattgcccatgaaaacctgcctttcttagttgaaagacttattagaagtacgtaataacctgtcctctggttcccaggtcatgtctacctgacttttttatatcattgccatcaggatagcttacctaaagtcagtgactccatgtagtgaactcatttctccttaaaagttctgtatctcttaatccaataagacacatgattgttttttgtttaattccaaaattgaggctattttggacaattgctaattaatatcatttgatgtccctgaataaatatatattgagaatttttacgttataaaacttagttggatctatataagctaatgacaaattttctttgctatgaagatctttaaataagtctctgaagatttatgtttttttgatccaaagagaggcttataactatgactgctttggagttagtagtacatacatgaatcctgttatctagtggaattttatatatgactgaggtcttgttccattagttttactatgtcatcacaattcctttttcgtaaaaaagtaaatatattagttgtacatacagggatatgcctggacaagtcatcgtgactctgtaccctacatagacatgtagaaataataggtagataataattcccctgattaacttagggtaaataaagttttgcattttacctgactggaaaccagggtcattgagtggaggatgcaagtagtgtctcctgatttattgcaggtctgagtcattacattttaaaatggtcatcagttgttggtttcatgtgcttaatattgacttcgttatttggtattgacttgaaatgattacaaagtatgtatttataatatgcttgtacgttgtatgttacaaagactcatcacaatggagtgtttagacctggggagtaagttggcaaacttagattaggtttcgttacaactaagtgtcacaaaaatcttctaattacataggtttcaaatttcttaaaatttggaatttaggctgatgacattttacaaatgtatttatattctagatgtggaagattcaggatatttttaataatttttttaaactatatatacatatcacatatatttacatatgtgtatgtgtctgcatatatgtatattacacacacacatctataaatagagattatattctcattatagagattttgcagtaggttttttttaaaattgatatcttgtttactggattcagccattgtgtcttaatatgaaatgaatgtggatagtgttattgtactccaagtccttttgcctataatctagaatggaataatagccagtgctatataatctaggcatattcaacaagtaactgggacatatattgccattgacaaacacagttcccttcctttctccaaccatatattttttaaaaagtctcctagctcttaaaggtgactgatgatgtggtgaggtgatcacctgtttatggccctagacttcagtgaactgaacagagttaaaggctttcctagttttattgctgacttgattgttattcctggaatcaactggatgttcttttcttgaaatactatgaacagtttgagctctgacaaagctgaaatgaggtattaaatgaccatgagaaaaatcttctgtatttattagcttatgagtcattcatagggattcataactttcatcataacatggtttgccaccatgttgactgtagtactgagagaggcttttgtaaagttgttaaaattattgctataattggccgggcgcggtggctcacgcctgtaatcccagcactttgggaggctgaggcgggtggatcacgaggtcaggagatcgagaccatcctggctaacacggtgaaaccccgtctgtacgaaaaatacagaaaaattagcctggcatagtggcacgcacctgtaatcccagctactcgggaggctgaggcaggagaatggcatgaacccaggaggtggagcttgcagtgagctgagatcatgccactgcacgctagcctgggcaacagagcaagactccgtttcctaataataataataataataataataataataataatatatatataaatattattgcgatttatcattctaaaccaattcactacatggatattaatgaagagagtagttttggacaaaatgagacgctactttttagtttccctatagtttgattatgagctaaaggacacataaacttactttttaaaattccatcaccttttcatccaccctaaatatgaacctaaccttgttttagtttctgctgacatctaaaacagtatgctgcagctgtgcctttttatttcaagcaggtaataaagttattgcagcaatgttttcaaatcaaggtgaataaaacgccatggtaatgcataggatataaaattcagtatgcaaaatttgcagtttcattgctgaaatgattcttcttatttcagcactttaggcagcaggaaagagccatgtcatagacattaaatactgtaattctacagatcttgcacttcaaaaactgaatacatatcacatggggacttgagagacaaaatcattgttgaatatgaagagcagcatatttagcatcagaattttctcctaccctgaattaaatttttgttcaagggacacacacacacacacacacacaagtattagtacaattatatacaatttcttattgatcttgtgtattcgaattagttttaaaatatataaatcggtgtgttttcttcacatggaaaatacttaaaacattttaattgatgtgatttgtagaaaagacaaaaaaaattaatgctagaattgtagctgtgccttttttttttttttttttttttttcacaagctggataaatcatttgattccacttggtcactaagcagttgcttagaatgtgttcttttgttccagtcaactaactcttttaattaaagagtaacaatttgtaggtgctatgtatcagtgtcagggcatttggcttgctacatcgttcagagtgtgagatgttacatcttactttttaagggcttaatgttaacacctgaaaattaaataagtaaataaataaagtttgggtattgtgttctccaagtgtcgattcttacattgaagtgtacattttaaaatgtggactaggtagaatttacgtagttttttccttccttccttccctccttccctccttccccctctccctttctcccttcttctcttcctcccttcctcccttcctccctctcctcccctccccgcttcctccatgccctcccctcccctccccttcccttcccttccctttttctgatatagggtctcattctgttgcccacactggagtgcagtagcgtgatcctggttcactacagcttcaactttcccaggctcaggtgatcttcccatctcagcctcccgagtagctgggaccacagctgccaccacacctggctaatttctgtattttttgtggagatggggtttcaccatgttgcgcaggctggtctcaaactcctgggctcgagcgatttgccttcctcagcctcctaaaatgctaggattacaggcatgagccactgctcccagctgataagtttttcttacggtggcatgggtaactttttttctttggggcattgttaaggcagtcattcattctataataatagtattgaactttgtcaggcgctaaaagaaacactgggaatgtaatgatgagaatgttttgtgggcacctaacaaattgtattgaaaaacaaggataaaagaaaaagctaagtcactcatggtcctggagttccctggtcactgctattaactttttggtatgttttcttttgcttttggtggttgctgattttgttttttcaggggtatgctttttacttttgaaagtgaaaactaataatctttataacttgtgttctgttgagaagttacaccatgatttacctcccattttcccatcactgattattttgatcaagtttttactttacttttaagcaaagactgaaagtatctccttatgataaatttcccaaagtgttattactttacacatatctatttcttgatacataaattattttccaaaaatactgttatcagttcacttgcctgtgagcaattcgtgtagtcacatgcccatttccctgtgtttccctggccacagtcaagccagtgtgaataaatgatcactgccacagccacagagcttgcactctcctcctcaaaattctgctccattgcccttttgaaaaatggaaatataagtgatatagttttaggtagggatacgtggtaaatttattattttcagcattgttaaaattattttctacattgttgagctgttctagaggaacctattattgttttggactagagattttttttttcgcttcagatttattaagttatgattaacaaataaaattgaatatatttaagttgtacaatgtggtcttttggtatatgtatacaatttgaaataattatcaagctaattaccatatatttatcatctcaccatttatttgtggtgagaatatttaatatctactctcatagaaatgttgaaatatataataaattattattaattatacttacctatattatagttatagtagacctccaaaacttattcatctgaacaaattctgtacactttgaacatctctccatttccctacaaactccccgccctgcccctgccctgccccggtgctcctggtaaccaccattctactctctgcttctatgagttcaagctttttagatttcacatataagtgagatcacgcagtatttgtctttctgtgcctggcttttgaataattgcccccagtagggagccactgggagagaatgaagaaactctgtttagctgaatataattaacagtaataaaaatatagtataaacaaacatatataatatcccattaaatagatactttattatttgtaattcttttttccccttttatctaaagttttctacctacttaccactgtgaaatcatgtgtgcttatttcatggttctcagaagttactcgtgtgtgaaatattgtaagcataggcatgggggcacagtacacactctttctttagttcatcatagctatatgcagacaccaatcgaattttcatagagatggtagtagatagtggtagctccttctgattgatacctacataggtactggcataggggcctcaggtcccaacatccaaactttgtgatgtcttagcattaactttatttgaccagtacaagcttatgagccacctgagtaatatgatttgaaaaaggtctccaggccaggcctggtggctcacaactgtaatcccagcactttgggaggctgaggtgggcagatcacctgcggtctggagtttcagaccagcctggccaacatggtaaaaccccatctctactaaaaatacaaaaattagctgggcgtggtggcaagtatctgtaatcccagctacttgggaggcagaggcaggagaattgcttgaccctgggaggccaaggttgtggtgagccaagatcacaccactgcactccagcctggataacagagcgagactctgtcaaaaaaaaaaaaaaaaaaaaaaaaaaaaggtatctatcacttgaattgatgggtttaagaatagattttaacataataaaacaaatttaactcaattctatcagtgtacaaagtaaataaaacttaatagtaatttagattaaaaaatttatagaatttgctgactgcattgtgagctaaaatatgagctaaatttatgatgagttgtttggcttcccaaggaacttgtgagaactgaaaatttgaagtatcagaaaaataacagtgtgaaatcatgaaagaattctcataaatatatctgggttgcagtttttaaactggcagtgtaggagaaaccttattaaatctaaaattttcaaatgtatacttcttattttaacatctaaggaaaagttaaattgtgttgttatacatatgatattaaatgtccaaataaattgcttctaaatatgaataacctgctttctgtttgttatgggagcaaaggtcatctttctattcatcagtaatattaagtttcttgaaatgctcaagaatttattaaattatgttaccaacttgttgacataatttaaaatcatttaaaattattgtaggggtagctgataaatgcctgaattagatggtccaatgatgtctttcttcttcctcttagcctccctcatgtccatttacttgcacttctagtaggtgatggggaagaaaattaaacaatgagaaacactgtgaatttgttgtctaacaggaaccagaactggataaaaattttagtgagggaaattataaagaaacagagtaaaactgacttcaaagtgattctttcatttaagtaaagaaatggtaacaaataaaaaaaattccatctgcagggcaaacattctagtgttgaatgtgttaatagagcagtggactcctgtaaaacatgattttcatcatctctgtttttcccttttacaaaaaatagtaaaaagaaaaatatgggccaggtgtggtggctcacacctgtaatcccagcattttgggaggccgaggtgggaggatcacaaggtcaggagtttgagaccagcctggccaatatagcgaaaccccgtctctactaaaaaatacaaaaattagccgggtgtggtggcatgcacctgtagtcccggctatttgggaggctgaggcaggagagtagcttgaacccgggaggcagaggttgcagtgagccgagactgctccattgcactccagcctgggtaacagatgagactctgtctcaaaaaaaaaaaaaaaaaaaaaaagaaaaagagtaaaatatgatatatatataaattattaactcttaaataatctgctactctggacccagctcagaaacttttgtaggtgaagtgttttctgctcacaagcttcctaccaactggagaaaaagtggagttgaaatatctggcaggaggaaggatgagatcatagtccatgtctgtggtaggctgaaaaatgccccccaaatagattctaatccttggaacctgtaatgttccttatatggaaaaatgatgtttgcaggtgtgattaagttaaggatgttgaaatggtgagaagatgctggattatacatatggggcctaactgcaatcacaagcatccatatccatatggaaggcagagggagatttgactacagacaggagaggagaaggcattgtgaacaaatgaaaggaatttggagggacaggaataccagcaccaccagaagttagaagactcaatcaactgattttctcctagagcctttataggaagtacggccttctgacagcttgattttgaccgagtggtactgatttcagatttctggcttccaggacttggagagaatctctgttgttttaagccaccaagtctgtagtaatttgttgcagcagccataggagaataatgtaatatcattgcctccttctgtagtggtaggactaatcttacgatactttatgtcaaggccccattgacaaataaaacccttaggaaggaggtaggattgagaggtatttaatttatctaattgggaaattaaatgtagaagtattttttgccttgacatttactttgttgctgacttttcctggatttatggcttctattttttattctgcattttattagttaactgaattttgctaagtgacacatgtgtttgtaaaataacattataataggaataactgaatgggagtattttttcataatgatttgcttgatttcaagacacttttaaaaattatttgaaataaaaataaaacaatttgaatatataattcgggttttataataggttcagttctagaataatgaatgtaagtcattaattggaagttaattggtaacatcggcaaagtttatcttatattttggggattgcatgcttcatttgatacctcctgtacaactgggatttattcgcacctcacttctgggtctggttgtgtattgttatgaagaatattaatattgctgcagaacgattacttgttcatttgtgaactgattaaaattcatgcataatttattgaaatgaatagaaattttataaataagccccattgttatcaagggcctgaaaacaaaatacatatgctaatataaagctactttttacctccaacataaaaatttaatatgtagtggtatattagcctcattaatgctagattttacatcttaaaatcatgctgttaatcaatacatatgcttttaagcctctcttaacattgccacatttccaaatttgagcaattgctttgatgctggactgcccccatttttggcctgaccatggaaagtgagatgtaaaactggccagagtgaactactacccttctgaccaagtcttgactgattacatcaaacttatttcttcatatacaaacaacactagtgttgaatattaattttcagtgttaaaatgtatatgctatatggcaaaacagaacaaagcaacctagcatcacacagggcttgttggtgtatgtaggagttgagtcttcaaaaattcttcaaataatgcctagtgcacgaatgaataaattataatgtgaaaaagttaaataacatatttaagattacacagctattaatgtgtaagcatttttttcatattaggtttccagactacaaatttttgttttcttttatatatcacttccttaaagatagaaatgttggaattaatgttgtgctttactgtttcacttatttctcttctttctttcacttgtttcttatgttgcggtatggctattttttctttccttcctctctcatcttttgctctcctcttaggttttctccttattttccatagcaagagtgtgcagagttttgattggtgagatttaccatttgatatactcacataagttcaggtttcagaatatctataaatttatgattaaccaaggtttgttatatataattcacttggcatattgtgactgtttattctatccctacactggggtagcaccccagcgagatgtgaatttagcattctttccaacttaaattagttagtatatgagccatctggaatgaaaacaaatattgcacatatgaggcaactcagtttattcacaaaatacagactgcttcttaaaatatgtgcagcatttaggtaatctcggaagacatttacattttttctattatgttcacttctcgattcagtttcattttagtttagggtttgagaatatatcaactttctccctctctacaaaaactttttaaaactctgagtacaaaagttgttagagcagttggtaaaatttcatggtatgaaatgtctagctctgtctttcatagttgataagtgaaaattctaaactgtgtttattttattcaaacttttttcttttgtgaataacttctccgttgaattcagtcgtgaaattggaaagagttcacttactatgcaattttgactacatattgttgaaacaatttgcaaactatcaggaatggatgttgtagttaaagtttgtaaatcatatgttaaccacttttctatagaaattataaatgtttgcacttcatatagcatatgttatcatctttgatcttagttttgtttttgttttaaacatgagcccagtgaatcccaaggtcatgtggttctacaaataattagtttaaaagttactgccataatgagccatgaatacttgtgaggagttacttatgtccttcaagtgattttggacaaaaaatattgatattacattcattatttatcagtcttctttttgtttcctatataaatttcagtttaaaataatgaattcattgatttctttttactatgtctcccctacaatgttatatggatacccaatgtgtaggacagcctaacaattaatagctactcaattaatatttatcatatgaattttgaaagaatcttcttgaaaattactttagcctgtgtagctgtacagaccagataatcttattcctaattttaaggttatttgtaattcagaggcttttaagctagaaactatacttttatacaatcagggttaaaaagaaaatcctggtctgcacctgaacattcttgtttcatttaaacctgcataagaaggtaaaacctgtctacaggccttatttgcattgtatatttttcatgcaatgcattgccattgaaacaaaaaatccaactagaaagatattgattatgtgctcatgacttccctctatttgtaccttcttcagtccaccccgtacctgtagtgggttggactgagggagcattttgtggttgtgttttaatagtttatgtgatttgctccaactcttaaaaaaagttttaaattaatttttgagcaattactactttattaacactttctttaggtcttttgactttcctgagaaaagtgagaagtgttccaggaattcaaagaactttatgagttattatcccttgtggaaagaccatatgaacagagctatagctgttgagtccttcataaagttcggtgtctcatttcagtcacattgttctaatgaaagaaaaaaaaagtgccttaatatatcattcaacttttctgtaagtacaaatgttgaaataatgttttccaaagtttctttcaagcagaatatcttaagatatccaaaattaaattatagtgtgcctttgatatttgagtttaatagttggtgaattgccttatcttatgctgctcccaaagaccagtgatgtttagtgatttgtgattgtgcctaggtgtaaatttaaatttgtcacactgtgaggcagatttgtagaaacaagttagcacctggcatcactttctgagttcggttatgttattctttcttcctttactcatctgtagaaactgtgaagaagtaacaaggaaagcaaaaagaaaaatacctcttgggcatagtttgtgaatgaaataaattgtcaaagatcaactctactctcttagtagctaattagagctatccatatctaaatattttctttttatttcctttgtatactgtgactttacaagttgatctcctgaaaaaaaatgtgtttttaatacaggaaaattatgttaaaatagtcatatgcacttgcaaaattatatgttctttaaaagtacagttgtcagatcatgcgtcttctagttttctttcaagtatttattatgcatttctaataaatgatccattaagcatttaggccttattagacactaatatatctttgtattattttaaatcttactaattgaagtgcacactcatctctcctagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcaggtaagactgagtagcagaccttttctaccttgtgaaggaatctagcataagacacattaatacatgcagtgttgaaggttctcattatttgatatatgatatagtcacactattaagagttccaatgaattacataaatcatcaccttgattatgtcataatttgactgatttgaggacatgggagtgcttctctattctcaagccattattattatgaatctagagtccttttttggcatggtagttttggtgagcctgctacatattcagtccaaaaatctctgatagctgtaattgaaagcattattgagagaaaagatcattttagttcaagcaaataccgaatacttttttactacgtggaaattctctccctcagtaattttgttacagtcagtgtaaaggccacatcttataatatggataagaaaagttactctggacaatgcctcgttgagataactattttcttcagaatgtcctgttgttgaggattacctcaggagcttgacacccagctgcagaacacagagagattttccttacactttaagcctttctgttgccttcctcatgactaaaactgagtagtgaaaataatagtgtatggagaaaacacaaaaaaaatgaaaattaaaaaattgtatataaccacacatcctggttctttaccatgttataatgggaggaattgttagctattaattaaaagccaataaaaagtttaaatatctaatttacttgactacatttttagtgtagtgtttattttgtcttttgtttcttgagcatctgtttatcattgacagtattgttgggctacccaccaggagtactgagctaccatccaagcaaaacccattcagttacctgatgtatcgtagaacatattttttagtccagcatcatatttatatatcaaaaactcctgctgaaagatgtttactaataggaaatttaacttctcaactattagcctgagacttagatgatagagagtccaataatttgctgattgctgtatatatttatctggttgttgaaaaggagcttaagctagaagatgttgggtaaatttccatggctcagcctaaatctcacaatttgcttttcaaatattctgtatgtctatgtcctttcaatcgaggtcatgtgacaaattgtttctgtgatagaagataaactttctgagggagaggcaagttgaccccataatctcaactagtcagagaaatcatttaaagaggaagcaatttggaaactaaaaattagttcactctctattccaaaattaatatcccatgctaatgtgaaaaattgaactatggagtccattttactaagaatactgcatacatgttttctaataaaattacacttttctacatatacatacatttataatgtacatataaattttaacaattttgacaatttggtattccagtgatttccctcttgacttcctgtgcccaaactactttcttttaaatatctcacctgctttatttttttattttcgtcaaaataggtctttaaaaaattagcattaccacacagtgtattgttaatataatgtaatttttgtttaacttaggaattatttgaaattggttccagatgtgaaagccatggagattgcatgtaaataatattgtgttttgaagccagttatactgtgttaagtggataaaaacatgttactgaatattgatttatccccatacttatgttctgagtggactttggactgtttaagtaaaaatattactataaagtgctttgaagtgttttattctgagaatagccctatctatgtgagagggaatgaggatagttaacttacactcatagctgcttttttgtcttgctctattgtccaggctagagtgcagtggcgtgatcttggctcactgcaacctctgcctcctgcgttcaagcaattctcctgtctcaacttcccgagtagctgggattacaggcatgcgctaccatgcccagctaatttttgtatttttgtagagatgggtttcaccatgttgcccaggctggtcttgaactcctgacctcaagtgatctgcccgcctcggcctaccaaagtgcttgaattacagctgtgagctaccgtgcctggcccatagctgctttctaacttataaatgtcttgatattttggaattatactgtctttttatctgattcttttttctgagaaacatttaatttgtgtattctttgtggcataaaatgctttcaggctcaatcacttgtagttttactcccaacagtattaagtttatttgtttttaaaactatctttcacatgtagtgaatttttatcacatgtttattatagctaattaatgtcctcataaggtatgtctgcaagatttttggggagggaagtacttatagactagattttcaggtagactgcaaatttgagagaaaccatggttactatttcatcaggaatgtctactaatcttgctctgttattagaaaataaagagaagcttatggaagtatatattgtattaatttttaaacagtctataaaaagaaatggaacataattgatatatagtataattaaatacagagtgttagttaggattatgatgtatgttcatccacttcccttctttaagatccatttacctttccccaaatttcaggtcccccagacttgaaattaccaataccactactggcctcagcccagaagttcatatcaacaaaatagaacacagtttatgttaactatgatattaactgaattttagtacagattgcaaaaacttataaatgcttcataatcttgggaaatacctttgagactccaaaaataacctttggaggaagttaccatctaattttgttaaattctgcatgcctaaatactggttctataagaggaactgaatactagatttataaaccattcttttttaattaggactgggactattccatgttacagttgtagaatttgccattaatataatctgattgaataaatgttgataattttaaagtagctattttaatagtccctgcatgttagactatgtggctgtaaaaataagtaccaatcaaaaagtaaattacttacaatttactgtttttaaaattccattttaaggtatttgaggcattgaccttttatttctgataatagtaaatgtttatttgatggaaatctgtcaataaataattttccagcaagtcaatacaaaggttttccttatttataataaaaaataaattttacattttcaaatgtaaatgtaggtttttttgtggccaagtatggattaatgctagtgtagaatcaacatatgaagtgaatgtatcatgatattttattttcacaccaatcctgtgaaatatattattttctcactttttagttggtaaatttaagactcaggaaacaaaaacaaaacagtaacttgtccaatatcagacagatgggcctcaactccttttctcagacttttaacggccttaatacttattcctcttattcctatcataggtgatttttctccctcttataatagtatagcatgagtaaataaaagcacaacaagtaaagtctggaagagatgtacattttaaaaaatagagtctgcatggctaacttattctctgagaaaatataggttaatatttgcaacttcacatttattgaaagcccaattgattagtgcttaactctccaatatatgctgtgttttaaatactttaaacagttaaagtgtaaaagtactttatccttttctgaaaatatcctgtctggttgccaaagctttttgtttgtttgttttccttccaaagtgcattataatcatttggtaactgcaattagttgcttcagggtctctgacttaggagaggtggtaattacagcctccagtggctgaagccactgaagcctacctcatgcttctctaggaacctgaggggtatgattatttcgctgttactttatactctgacccatgctattgttcacataatgtttcttcaggcacttcataaatttttaatttgtcttaaaagggaagtaattcagaaactccagtgaacaatcagagaaagtatgcttgctttttttttttctgtgtgtctatttcctctgggtataccatctggtatagaagctaggcaaatacagtttctctttctcttattaaatggaaataaaatatgccatcatcagaaattgtctgtgttgcatgctttggcaattgcatgttaaaattgctcttttaaattgccttctgcttctgggtaacccattgtggaactgctttatgattaactgacattttagcagcatctctctcatagggaaggtcaatagttcagagtgtccagaacataatacatttatgcagttgggaaaactactctctactcttatattgaagttcaatgctcttggcaattttcagtgaaacagttagatctatgaagcagtgaaaaggagagtgtcttattttaaaagtaagcatttactaaaaatgcattttttttcttgtcccaaatccaaaatggaaggaaaaacaaaacaaaataatactcaggcatataccagaaaccacaaagtgagaagttaaattttagcctttagtctatagcatcatcagcaaaatggtaccatatattgatttttgctatggtttaagatagttatcaatcacaaagactagtaaccgctaacactcagcctagaggttgaaacaaaataaacaactcttctaagagttggttcggtttcacaatgtaaggatgacttactatttgatttaaattgttggcttatatcaatgcttgctttaaatttttttgaaatgtatgagcttcttatatatgatctttatatggctttgtattgtttttgagcaagaaatttaaaaggcaatgctattattattattgaaataaaaaacaaactaaaggtaaaaagccacaggaaaagtaatggaagcagttcttcaattttcttgggaatgtaagaataaaatttcattttagatttcctttttgtgagtaataacctaatttttggtttttagattctgtagagaatacttctgtttgaaaaatatttattcagaaaaaaacttctgttggcttctttctttgttaacagtaccgtgttaattaataggtcttcaaagttatacaaccaatgcctcacacttaagctcctagaagtcactagggaccagacctataaacagaataaatgcaaagtgaaatgaataaaatgagagcaaactgcatgtttttacctcctcgtaaacattaatgatatttttgggtttctgaaaatagatgggttcaggtggatcactggctaactctaggcttgtggtagaactgaggctggcaggtgagctgcagctaagtctaacatgatctacctctaatggataatgtataggtagtcaacacctatacattctgctaattttcaggtagactgcaaatttgagagaaaccatggttactatttcatcaggaatgtctactaatcttgctctgttattagaaaagaaagagaatatattatggataataacataatctaacatgattacctagttgtttgtatgatacagactgacattactagatttgtttgtaaaaggatcatcccatctctggaagctaaggaaggactagaagcagagagatcatgaaaacatgcatatagatagatagatagatagatagatagatagatagatagatagatgtcttctctacagcatctttctcatttcaaatcagaaacaggaaatccataaattcctggaaaatattatcattcataataatcaggaaggttacttttataaggggattttaaagatatgttataagtgaataactttattgtttgaattacttttcttattcaaatatgtgaattgtccaatattaatacacatgaaaaaaatggtataatacattatattagaggggaaaatcatgagagattggagataaattcaagagctactgtgtatttgatgagatgtttaattatttcacaaattttagtgagggcccaagttgtacacatcgccacacgcaggactgcagaagataaaacattgagaagacaacattcctgctcttaaggaattgacaggctagtgttataaccataataaaaatataataaatgatacaataaaaatataacatacttcagtaatccaaagaagagagggataatatctgaccaaaaataatttttcccaaacactattaatttttctaaacagagttggtttaatgcttccgttgaacaaagccatggccttatccataattccttacttgtgaaataatgcataaaacaatgtctagccagtagtcaccataaggatggtttgccttccctctttcctttctactcagatataggaaatctatatggacagatggaggtattaaaatgaaagatatagttcatattctaatatatatcatcaaagttgtttgtgtttttttaaacctctggggttcatgggaatatagaaatgttattctaaatttctatggaaatggagagacagagacagactgacttataaggtaatcaacacctatacattctgctaatggtctattatgctaggagttcccagcataagagtcatgaaagttgaacaaatatgaaatagccttgcccagtaccttttgggtttcacctcaggagcaggttgtacagttagtcatacatcccaattcaaggcacatttccttataggtggtatcatcagtagcagtgtaattaactttactaatagagttgggttgttttcaccttaaaattgtgtcatctgactgactagttggtgaaagacatttggtaaccagtgttaatgacactgtatttatttattcatagtactttaccacatgctgagtctgttaactgtatcattaagtactctttttattggctttgtttgtttttattgaattttgcataactacaataaatcttcaggtagaaatgatttgaataacagcatcagtctcatgaaatgttctttcccctcaagtcctaggttttttatttgatatcaggaagtagaaatggctttaaaagtaaaatggtatatttataatgtcttaaatgatgataacaccaggagtatatgatgaagaaaatgacctagatagaattttaaagatatagatctaggcatcaaactctaagggatgtgttagtcacaaagacaggttcaagagatctagcctgtgagtttgagacttttctttgatggtgctattggggtcactatgaggtatagacttgctcttgattttctttctctttacctagagaatttacttctgtcttcaattctcacaccctattcatatcttttgttgaattgtgatttcctttctttgttttgaaatatgaaagaaatctctaaatcaggttctgacagatgggtatggataaccatacccatcctaggtattattagcattttgggggagtgttggtcattctgtgcaatttcttgattgaaaaaaatgatatatggatgaatctcattattttcatcatttaatttgactcattactacatggaatcatcagcttaggatctcactttctggtcttcattgtcttcctgcaagatatggccttatcatggctaataattgctggaggataactcttcaatcttctttcctctccaccaacctgaatgtaaactgcagaggggaaaaaaagcatgttcaaaggaaaaagcaaatgagtgaattctaatcccaagtcttcttatttatagtaaactttgtgaactcagtaaaaaatgaacttcaaagggcagaaattcatgccttttatgtcaccctaagcaagatctgtgcaaattcagctgtcactacatatgatatggcctagaaatcattgagtgatgttcattttaattgtctcagccaaatcatctcagtgaagttgagtttaaagaactcatctttcattctttggctatgttattatttcccacttctacatagtccctcaccacaacaaaataataataagcaatcataaaacagtttattattacctgttaattaaattattttaagcagttgctatattctgtcctgttattcaacctacccaaaatttactaaaaaccatatttttgttacatatgaacctataataccttttgctaatacaaggaatatacacacacatatgcatatatatatgtacacactctccttttaagaggaattaattttaaaaatttagataccaccttaaaaattatattagtgaagaatattaaagcagagtcattgttccagagtcctctttcctgcttctccatctctctcctccagctaattttgcatttcatgcatgtgtgtgcattgtgcatgtttggatgttgtgcttttatttggggtggggggcagatactgatttagagttttctttctacaacagccaaatcctttctgtttaggtggataaaatgtgacatgggtgaactagctatccttaagcttgatttctttggagggcccttgctggaagtcccatattctgtaaagactgcatagagcttacgtacccaaattatttttttaaattatgtatatattaaaataatacatcaaatgttgcaactagaatttagaaaaaaactcattattttagaatgtttacaaaactattgtcatttttgtcaatgcactattatttttctctgttcctgggagtattttagttgtaaagtacaaagtatatacagttctatattccgcttattgtaattgccatcatgccaacccatttcctttgtttctacagaacattatcaccatcactttaaatgactgcttaatattctgttggatatatatatatatctgaatgtatgtaaccattcttatgttactgaaagtttggactaactcccgctattggccattgtaaaagccgcggtgaagatcatgaatgtaccttttttccacataactgaaaagttcttgacaaatactattcaactactttttgaaagtattatatcaatgcgctttactgacaccatcaaggccaatcatatggttttagtgcaagtaagtgctttataattaatcaagtccaactcctttattaatcatcattctgggcatttagtctcaatagggaagtgatttgatcaatatcaaacagctattgtaggagaaaaaccaagactatcatttgtattgcatttttaagcttttcttttacatgagtatctcctgtattctagactctgtctaaattactggatattctaagataaaaactctgttctctagctactcaaagtctagagaattatgattacagtagctcacaagtactgagtaattgctgtgtgtcaggcactagtgtaaactcataaatgcaaactgaggctgcctgaatgcatttctgtgttgagctgcccagaatggttagaaggtagacatgcaggttaataattaaaccaataagctgtataatagatgtgcacaaaacatctctaaaatatgagtataatttcatcaagcagtcaatcagtaaaataggtggttatcttaaggtttgagagccagtaaagtctaggttcaaatcttgctgtaatccttactgatgtgcaagtaatttaatgtaatgtttcacttcttcatctataaaataaaaatcaataactgaacctgcccaatttgatacttttgagctatttgggcatgtactaaagctaacaatcaatttattaaatttgcaggaattttgccagctggttgtgaaatgattattttgaaataaatttatatatatttacaagtatattttaaacaaaggaacatgcacttaaacctcctagttattttaatatattataccattatttctattcttgaggttatttatgtttattttatctgtatgttggaaacactatataatgatcctctgatgctcacttattcctaatttttacgctagtggcaacgttagagcactgaaattttaagtgctacaaatgagggtttcttttccctccccactccttcttctttctggatagccacaaacatgtttacaatattaaacatttttccttcacatcaatggagatgactcctgcagagtgcttacttagcacaatgtatgagacataagaagaccatagtaaatattagccattgctacattaaaagtcatttcattaaagatatttttcctctaatattttaaaaactacaaacatgcagaaatctgaaggaattatacagtgaacactcatatgtccaccactataatttacctttgctgtatttgctatactaaatgttgatctacctttacatctttttattcatccatcagttcatcttaattcttaattaatacattaaaatattttatgtaagggaatacattttttaaagaatgaattatttgaatttttattagaatgcttagaataatttgtgttttctaaagatttctctaatgatagtttaagaaaaggactgaaaggagatttcagaaagattagaaggctgctacttcagtctaagcaaaaattgatcagtacttgaaccgaagcagaggagataagaattccaatgaggagacaggtgttgaaagagatttgataggtagaatcagtagaacttggtgacacattggaagtgaattctggcttggaacattaaggtatagggacaggttttaacttgaagggctcaaacattggggaaagttttagaaggcaaatctctgtgcttatttttagaaatgaggcattgggtcaggcagttattttcctgggtttatggttcatagagagggcagacagcaggatatacagatttaagtgtcatcaccatttaattcctcttgcgagattcatgagtatactataatttccttgaattggaaattgaagtaagtttctttcaaccacatttttagaaattatgctcttgtaggaaaaatttcactgtatatgttagtatcttattgcatgaactattctgattactcaagcctccctgctcaagggcagaaactggtaattattttacatagagataacttaaaaatatgtagcagattgttttgtgttcacaagtatttaaatttgttcaatatgtgatttatgaactgtgatcagtttgttgaattgtgatttctgtagctgcattttaattgttccccagaatgggtagctcagagcattatgctaagggcagaatcaaatgtagtttactgttggtttttatcatccaatcccaggcatacttgcaagtaagctaatgtgtgttgagcatatttctatattcgtccctttattgctctcttacttctcattgtccctcaccctagtggttcctggtgctcatatgctgtatatgcacccttcagatgcctccacaggatgacaggagaaggacctgagcatatggccccatgattagcagtgctggtgtgcccattctttggaatatattgatatacctatagttcgtgtgtgtgagagaatatatatgtatatatgctagatatagaatatatgtcatatacacacgtatgtacacacatatgtacatgttacacacttatatgtacgtgtgtatatgtatgtgcatatcatatacatacatatatatctagtatatatacattgatatgcatatatctatagtgggtgtgtatatatatacacattatatatatacacacacactatatatatatatctacatatcagtattactttgatatcttactacaacatccaattagaacaacttatttttaaaattttttatcaagttctacacttgagtgctttggtaatgagcgaaaataattaccctgattttttaaacccttgagtcagaagcctctgtaggacaaacttaaatatttagactttccaaggattttcagtagcacaggggagataaagcacctatctctctttcagtgaagagaagaaaataaatgtttctaccctttcagattttactggaatgttattataaactaaaaagtaggtcagcaagactgagttgttttattaagaacagcagtacaaatatcatctgaagaagatgactgtacaattgcctattattaaaacaaaggtagggaaaattgttagtgattcattccctaagctgttccagtccttaagtatgatgctaattatcctgggtattaatttgatttctacttttttagctgatctcctttatctcagtgataacatttttataattataattttgtaaataaccagtaagcccatttttaaagctctgcttagtcaaatcagttattagttgtgtagtgaaaagattttcaaaacattctccagagttggttgatcaatcccttattttttaagaagacgagttagaagtgcctcaattatgaaattggctctaagagagtcaaatttggaaatctaagcttttagaaacatatttttgactgaaacatgtatacatatacttgtaataataaagttaaaatggggtaaatgttacctttatcttaaatttaacatcaagaattgatctaatgaagaaattcatccagaatttaaaatattcttctataaaacaatagggcatacttacagccctttaatatacaaatcatcagaagtctctaaataatagagaaatcaatgtctacttcatgcagcacaacagcaaaacagagctgctcccttattacaaacagtacataatagtttaattttcatgggactagtaacgcatttgttatatcgtggtttttagtgaggaatattgtatatgtcttcagttaaaaatatattctcagcttggacaggtggtacttaaagagtctggagtgagaaatggtttggcaggataacaaggcatattacaagtgcctgccttgaaaggtaagaaagagagttagacattttccattactacctactgttaaggtgctcgcattatcccctaaacaacctcatgcttgtggcaataatcatgcactgtcggttttttgtactaatatgaaagtgcggttcaatctttttgacaaatactgcatcatttctggcttggtgaatttttgtcactcaaacctagttgatgtgtaagtaggttgtgacatgctggctgaaatgactttggatccactgtattgaagaaagtaaaattttacttgaagtgtttcttctttccatttctcactcttctctctactccacctagacctcactccttccctgagtttagattcatcctacttcctttgtaaggtacatcattatacattatatgggagaattatcttatagtgaaactgaaggaagcttttcatggaaatgtgtaattcgtttattattttctaaactgtgtatttgcacgtgtatccatatgcatcactgcacaatctaagtgttaacagtttttttttttttgctttcttactagggcttatgtctaaaaatgctagtttgcaatatctataacactagcattttaaagtcattcataatctgtcaattgatatgaaatataaacattctgcctttttactttcattattttagtgataaattttgtactgcttaaatgttctctgcaagtctgtgtggtttggaaggaattgtcgttttaatttcttcttctttagtgacaacatgtgcatctattatggaaaaaaatgaaaggtaacaacagttgttaatttaagagatgaccatgaattctcagtgctagctcccaaggtggcactcctaagaaagaggtcatttctcaagtaaataatatgccaggtaagatctgtttgcattttaaataaagtgattgatttaggaaatattacctttagaaagtgcaagttcaaatgaatagttttctttaaccccccaaataagattataaaggaattacccatgtcatgagttttttgttgttcttgttgttttaatcattgtctcctagtaaagtaggctttgctgagtaaaaacatagaaatagacttatctattgatggataagtataatggataggtataaattaagcgtagatgtagagacaaagatgtagctatcttccctgtcacttatttgtggcctgcaggggagttttaactcatccccaacactcgggctcccacaggcagtattcaggatctgccttggtctgttttgtggtgtttgtttcatgaagtttcttattaggctttgtgttattcaaaattaaaattttacatacgatagtccaactaataatttaggaaatcatattgccattattaaaacttgctcacagtctaatttaaataaaatctgagtaaaaacaaaaggaagatgcctactataatttgaagatattcattcactaacgtttcaacatttattttgtcaccattaatttattttgtttttcaaataaaaagtaaactgtattatcccatatagttctggaaagtgcctggtgtttatcataaaattatatatattatttgtctccattgtaatagtggccttaaaataatacacacacacacacacacacacacacacacacacacattaaaaaaataacatatttaagtgggaattggaaagaaatgcttaacaataacaagatggttttataaattatgttatgtctatgtattaagcattttttagccattaaagttatttgtgtaacgtcttaatccaataatgaacataatacaatgttaaatgagagaatcaaggtatgatgaaataacaataaaaaataccctatgtgatacttgtggagatcaggaaataattgtatgggtaattttctcatctattaactttatttcaagtcatttcattggtaaaaataaatacttttaaaagagaaaatttaccagaaagaaaataaagagattgatctatagcaataagcatgaatttaactaacacatggcttacttaagcttctttgttttttttcttttaaaaataggtttttctaacttaggcttgggtctgtttattttttattgtatatgttaaaatatacaatgtgttttgacatacatgtagatgctgaaataattactatagttaaacaaatttacatatagctcaccttccatagttatccttttgtagggtgtcagagcacctgaaatctactctttttgcagtgctttcagtttacaataggatattattaactatagtcttcatgctgtacatttttgtctgtctacttaatgttcctaacctgactgcaaatgtatagcctgtaaccgattctccagatattctccccctccctgctctctgtttctcatttgacttcaagaaaaaaagattccacatttaagtgaggtcacagtattttctgcctgtgtctggcttatttcacttagcatagtgtcctccaggtttacccacgatgtcacaaatgtcaggattgccttttttagggaagaattatgtagatatatgtcacaatttctttatccatttatccactgatgggcatttagcttgttttcatatcttggctattgtgaataatgctgtagtgcagcggtccccaaccttattggcaccagggaccagtttcatggaagacagtatttccatggactgaggaggtggcaggggatggtttcagggtgcaacgctgctacctcagatcatcaggcattagttagattctcataaggagcacacaacctatttaaaacattatgcacagttcacaatagggtttacgctcccatgagaatctaatgccgccacttatatggcaggaggtggtgctcgggtggtgattctcccttgccttccgctcacctcctgctgtgcaacccagtttctaacaggctgtggaccagtaccagtgtgtcactaggggtttggggacctctgctgtagtgaacatgggagtacagatatctccacaaggtgccaattgctgagtcatatgatagttatccttttcattttttgtagcacctcaatgctgtttttataatggttgttcaactttcatttccacctgcaaaagagaacaagggttccttttctctaccacctcaccaacacttagggctgtttatattttgagcaaagtcctttttcactttcatttcaatcaaaatgcaagaaagaattaaattgagctgccgcttatttgggagatgtcacaagatttacttcctaagagtttgtgagaagaacacattttctggcatttgctgttgatccagaagcattttcattgcagtgactttgtttggagattttaacttctaagtactactcttattttgctctgcttttaggataatgttttaaataagatttttaaagtttctcaaaactgaaaacattttacctcagagtagaactcagttaaatttttatttaaaagtaggtttttggtaacagtaaatgttttgacaagtttttacttaatggttaataaaatgctactaggtcaggtgcaggaagtaaaattagtcctaaattgaatttgaggaaggcatgtaagtagaagtaatattaagaaggtgaatcatcagttgtatgatagaactgttactaataaatacaacatgtggtaattgcaagaattaagttcatgaaatgtctattcaactttacaatcttgccctactagagtatttagtcatagggaaccttactgtggttggactctgcctggcaatgcagtttaacttaaaattatctaggaattatttttataggaaattttgctaaaatccacctagttatatgaagtatattactcttgagtagcaaccaagtaactcaaactgtaatttaaccctgttaatggagggaagtaatatggaaatactaaaattgacattttacaaagttgatcccagtatatctcagatgaaaaaaactagaataatatataagaaaacaattttatacattccttttgttcaatttagaaataagtcattacagatatcttgcatggcaaatattaatgcaattaacttttttaacttctgagattatttttaatttaaacttgtatgtttaagatttattttgtttgtttagagtgcttgccagcaaacgctgtgttaatgtaatcttaactattaaaattggattttttttctggctgtgtacatatttctgtcattttgctttctcatcaaccagttaaaatatttttttttctgttcatgtgagtttttcatttatatttatgtataaggcacagcacaggctgtgtttcaagtaaaatattggactgattttgagggagttttttttgtttctatcatttttagtctttttgaggaagttgaatatttttccagaagtgctatactttattcctagtactttccagatgatattgataactccaggaacactaggaaacagaaaacgtaatatcaatgttaattttatagaatataaaatgttattcaactggcctttattttatttacatatttacatagggatatatgtgtaatttacatcattcctaatttcaagaataattctaagttatttactaaagcacaaaaagatttaacagaagaatactaagttgataagtaattttgggaaaaatagtgatactaaaggtaaaataaatgaacttgggggataatgagagtaaacaaaaatttatgtttatagagttttgttactagaggagagtcttatgttattagaagacaccatagatttgatgctaaatgtactagtaataaaagcaaaatctgtatcaattactacagtatttattatttataatatagcagctaatgcttaccagccactcataacattctaaaaactttgtccagcatttgatacgattatcttatttaattattgcaatgaccctgaggagtcctgatgttgttatattttacatttgcagaaacagaatctcaaagaagttaagtgcctttcctgagatcacacagctattagctggttgagctgggaagtctgagtccaaaatctatgctcttattcacagaataaacatttttaaggggataaaatattaataaatcagaaaagcataccttgtcttaattctaaagataagaaaaaaaaattttctgttgggattatgcttggttcaaggataaagtggagcctatctaggggaatgtccgtaatgcataaccttcaggcaatccttgtgaatatctctttgctctttgttgttaccaaattattttgtcttaaggctatgagaaaattgactttctaaaagctgtgtctccgatgaacagttaatactaaagccaaggggaagacgtactggtcagaattatagtaactttatccttacatatatctagaagaaatactcttgtaactgagagctaaatctagaaattcttctgtcatgcagaattttgataaatgtccaatgctatttttagttttaaatgttttttacgtatatgttttatttttgtatcatctttcacttaactattgaactacagttgttctgtgatataaactcttacaaacaatatagatttggctttagtttcattaatttttcataaatgcttgagtattcatagtaccttatgaatttatgataaatttattacagatttattcaggcagagacatatttgaaaatttgtaatgaggaaaaaaaatcatcttatgaacagctccataattttactttcctaattgtgtgtaccttttgggtctattttatatttatttaagtttatattggtatttatatattcatataaatacttattacatatttatataggaataatgcgaagccatggttaacttcataatccagggatgcaggcttaccaaaagactgagacctcatcataggatagaatgattttccttctcacaatataaaaagtaaagaaaaataaattaaccaaaacctctctcatgcaaaaagaaaacattattaacttttggtgaaattcagacatctcttcctgtgtgcatactgtatgtaaagaggaaaaaggggaagaattaatggttggataaaataaatgtacacaatatactttatatgtattacttcctaataaaaattatttcttttttatataacaaaattggaaactaaggtaaaactgaaataattactgttgattagggaaaactttcccatcacatgtgtttctgtcatttcttttgtttctcccttgatttaggttttttttaatgcggtaggccaaagtcttaggtgatttgatattagttttagcataatttgcacacatagaattcacagaagatataatttcatgcaaacatgtaaactttcaactgtaaaatttgtatgaaggactgttatgtttgctatgatatggggagaccatttagtcaatgaggtctttgtacttccattgtgataatttagatagcttttattttctgaaatgtgtttgaaaatgtggaaaatattttaatatttccctggtttttttggctttcatgctaatatatacatacattctaatgtatattatattccatataatgtatattttctgccatttttcaagtgttcttttcccctggcctttcttctaccctccaataatttattaaatgtttttaatctccccccccagcctgtaatttagttttgtgcattttaaagcagtattggttatatgcacttcagcaaaccagtttatgccagctaaagattgaaaaggagaaattaatttaagatttagttctgtgttttttaaaacctttttaaagatgaagatattgatcttgtattactagtattgaagcaaactcatattgtttagttccttatcataagttagaggcgttggagggttaaagttttaccaaagtaaatcataatagaactggacaatttaatagtgatgtcatatacaaaagctcaattaataatcctatacaaccagtaggtgaagattttattttattaataaagcatctgaaaatgagcctagggtcataacttttaagaactaggattatagggtcatgctttattcatgaatagtagacatgctttctctatagtgagctaagctatacttctgaacttgaatgattgtctcagtgttacctttatctcagattcatcattcatattccttttgaaatatctttatcttggtatagatatttatgtgtaaacacaatagttgctatgtaatagtttctgtttagccattaattggagatacgtaattagagttggtgctggggtatcttctagaagaaaatgagaaggagtgagggatttgggtgtgtcaaaggaagataatggagaggacttgaaagaattcttctaaaatgagaattcttactatgcatgtccatgaattgtatttaggccataggagaacttgtacaagaaaataaaatatgtcccacttcactactctctaatttagcatttcctttaattgcaaatagtccacaaactacaatagtgttagtagcaacaatgacttcatctccaacaaacattgcagatattcttatatcacattacagatgtttcagatagcttggaatatgatttattgttcactactttgaaattacaatatttattagacttccctctattaaatgcgttggtaaagtaatatagttatgtattatagtttctgttggaattctctgcattttattttaagcattttttaaccttattctcacaaacggactaagcttcagtagactgccaaagggatccatagcataaaaaatataaaaccctagctctaagaagtaagctaattcagctttttattaacctttattctattccaaatgtgataacatttctccattttatctgccaccatgcataaagttataagggaaattgcaaaatatttttctaccaagctacctattttatattcagattattttagtattaagttcatcttgtaacatgttttaggctttggaagattagccttaatgtttttatttgtcaatataaatttatattaaaatacatattattaatacttatttctaacatattatttattattttcagtgcactgtgctaaggattcacctccattattgcattcaattcagcaacctcatgagcttaggtttaatcatgcatttgtatttttatagaataaatctacccaagagaatggggaaaatgaaaaattgttaactaatttaagcccatcccagtccaaaaccagtcgaaacatctcaatgaagtaaaggtagaatgataactgcatttacaaatatttcttggtaggaaaaaagtattttattctaataaatagaaacatgttaagcataatgttattcatattaataatgaatattaaacattaacattaagtattatatataaaacattaacatattaaacataaataagtagaaagttaggtttcattttgatcttaataatttaagagtaacaactggcacagtgttcaaataagtagcacctagaattgtgctaatcacatagaaaaacagaaaacccgaaggcacaaaagcctatcagtgttgatgtccacattgctgttttccaagtatttgactaccgtctctgagcaagattctctacagatcttatcaatatttgtagcttcctgcaatttgttttactactcaaagtttacgattaatggacctctccctaatagatttaactaagtatgtctgctctttctttcattaattgagcacatgaagtatgtgactcattcttaagttgaaatactgccttcagcaaggatttgacaatcaattcaatcaattatttctaaatatatttggatttattgctttcatctcaggctctttctgtatatatgaaaagtgttaagacagttttaaggagtgcatgagctatacccacattctggctttcccaacacatgcagacatgggaaggcccaaaaagaggtcagtgtcctctcattttctctttcatgcacaaatgtataaacacacgcaaagacacagaggacaaaacaagataaaatggagtaaatttagattttaaaaaatgtaagattcagttcactggtagctgtattatatatcatacatttttagcaacacatgtaagatttatgtcttgaataatataaaaaaaggttcatctgcttgtaaaatgtaagtcttatagttcaacataatagataaacatcaaaactagtatcctcattaggttgtataatggtatattgccacttactgttatttaaatgtcatccccatttcctttttgtagtgctgatgttaaccttgtaagctctaaattgtctggaagttaatggtctgttatatgagtttcatagttcttagtgaaagaatattagattatattatgcagtttgaaatgtaacttgatctctacctcataatcataagtaatgacatagtcttggttgaaattagggacgtttgctttttctgctgatgctgtccatagtataaatgataatttttatttttttgttttaaattgacaaatatgtttatttgtccattcattacacccaagtttatgagggttagaaaagagaacaaatataagcatataagagtacagtgtacttcttgaaaatcaaactttgaaatttatcttattaaagttggtaaattcagaagcattatattctgtcagcacccacatatacccttgtctggctttgagagagttttatttttttaattttataagagttaaatttgaattggagctaatgtaactgacaagagggaaatagaagcaattggcttgcactaaacaagtttgaatggttgttaatgtgaatgactttcaggcagtgaatgtcagagaacagtagattactttctttacctcgggcattttaaaccatctcctgtggtaggattaacataatttctctctctctttcttgaatctaggaagcaaagtaattggagtctggtaattttggcctgtgggtgatgaagataaatcataacaagctatggaatacacattgacaattcacatagggctactagaacatgaactttcagtaatgcattaaacaaatattgtttctttctgatttatattcaagaaagccacagaactgttaattatgaatgcagttatcgtttgttatttttgactaaattcacatgcaaaacaaattgtttcaaaatataagctattgtgttcttaaacatgggctaagaagttgtatcttttatatgattttgagtgatcatatttgtttaaccgaaattatttgagattttaaaagaatagaggtggaagagaatacaagaccatctggtctagcccctctccttaaggcttataaatgtatacatcatcttgagcagatggaggtgtactcacctaaaattttatacaaatataggttctacagttccattcaatatcttattcttgaatttggtcactaaagcattaaaggatcctattttatattcagattattttagtattaagttcatcttgtaacatgttttaggctttggaagattagccttaatgtttttatttgtcaatataaatttatattaaaatacatattattaatacttatttctaacatattatttattatttgcagtgcactgtgctaaggattcacctccattattacattcaatttagcaacctcatgagcttaggttttgttgtctccattacagatttaggaaagcaagagtaaggaaagttaagtaatgtggccaagcacatggctaatgaaaagagttgctataacttaaatttctggactaaactttttcctactgatctacctcctcagtgttaagagtgcaaactccttctctcttagggcaaaatttctgtcactttgttgttcatccactttgtatcatcttatagtcctcttttctcagctaatgggagtatatctcgtgtttttgaaacttttgttcattatcatccataccagccattttagaatttgtttcctaatgtcttctgatgaaatttttaataccacaaatatgctgtgtatctgtttatgtatgtgtataaaaagagtagtattttttgtcccctctaagaatcagtttcccccttggtactgatattgctcccttttagaatgaatgtagttatcactattactgtacatttttgattgcataagtacataattatttttacttaatatgaaatgttaatttgttagagtatgaaaatattaaaatatcaacagtaattgtcctctttttaagttacgtgagctttccaatgccctgaaatgagaataattttgaagaagaatatagatatcaagatataaatgaagtttaattcttttataacaatatgtaatttgtgctactaaagaaacctcaggatgtaagtaaacataatcctgcccattttacctgtttttagaccttttgctaaattttttgtttatccaaatatatgccatcttaccataaatctgtattcctctctgttttgacatcacaatctattgccatggaagtgattgatagcttacatttatcttcatgtcttcagagcaggttcataaggagactgtctggaagaaatagactttattggtaccagcacaagcagacttttagaggtcctgtacaagtttacgtccatctgtattttttttttaaatacaagagttgcaaattggtactttagaaagtgtgaagactttgcttttcattctgtaatttccattcaaaaaccatatttgattatgattctttctaaaatattcaaataatgggttttccacaactttcatactttaaatataaaatgagcttacaacccgtgagtaggaaactgtggtaatggaacatattcagctttatcatgttatgcagaaatacagcagttaggaatgaaacctcattgataggttcttttactgggaaataaaccagaaggtgatgaaaatcacttggcatttttatatgtagtttgtagaaagttcctagtctggggctttgatctacttcattggatcaaaaacataataaattgaatcttgaaacttgctatatccttttggaattacacctaatattgaattattcatgtagatgaaactgatcatttaggtttcagaatttctttttttctgtaatggttccagttcttttttgcatgaagttttttgttgttgttgttttatactgaattttacaacccttcagatataaaagaggcatttctgtactgtctcttgtcactcaaaactaattttgatttcattgactaccccatatatgttcagaaactaaaataatttcaatatagtcaattaattaagtgaaggatttttgacccctacaatgattttgatctgtattagtcttgaggaggtaagaacttcaaaaattattacctgtgagggagcccatgacaaccatcacattttcatgtacatacagaaaagaatgatactgtatataggagtaaagtagaggaattaaacaagcttcctattcaaatgaagattttttaaaaagctataactattaactgtttgatgaaggttttgaaaggaaacgtgaagtggccactgtgcagatatggtttgagtgacttaacgggtcaagtatttgacaacagtaatgcttcctgtggtttttatatgaaggaaaaaatgaaaaataggaaacagaaaccagaagtttatgtaaacctacataaattaactcttaaatgatttattttattttgaagtgtctgtgtattgtggatgaaccaaacgttcagactttcttccagtgctcttggccctcctctattaaatgtgtgtcttgttccctttccagcgtacatacagctcagtcagtaggaactagacagagaagctgttcacttaaaaagttgtcatttccttatagatactttcttttctttattattatactttaagttctagggtacatgtgcacaacgcgcaggtttgttacatatgtatacatgtgccatgttggtgttctgcacccattaactcatcatttacattaggtatttctcctaatgccttcactcccccctgcccccaccccacgacaggccccagtgtgtgatgttcctctccctgtgtccaagtgttctcattgttcgattcccacctatgagtgagaacttgcagcgtttggttttctgtccttgtgatgtagaaagctgaaactggatcccttccttacaccttatacaaaaattaattcaagatggattaaagacttaaatgttagacctaaaaccataaaaaccctaggagaaaacctaggcaataccattcaggacataggcatgggcaaggacttcatgtctaaaacaccaaaagcaatggcaacaaaagccaaaattgacaaatgggatctaattaaactaaagagcttctgcacagctaaagaaactaccatcaaagtgaacaggcaacccacagaatgggagaaaatttttgcaatctacccatctgacaaagggctaatatccagaatctacaaagaacttaaacagatttacaagaaaaaatcaaccccatcaaaaagtgggtgaaggatatgaacagacgcttctcaaaagaagacatttatgcagccagtagacacatgaaaaaatgttcatcatcactggccatcagagaaatgcaaatcaaaaccaaaatgagataccatctcacaccagttagaatggcaatccttatagatactttaaatattatttttcttgagtatttatatttaatgcaactggaaaagaaataaacttagaaatttaaatgactgtggaatgtttttaaccattcacaagctgtataataatccataataatccaaaacaaatatcaagtcactttagttttagagaaatgttattctttataggtttgtggtttatttagtcaactgtgatgtgcttcataatactgatataaatatatgtttaaaaagatagttaaaaataatctcatgtatatgttttaagaaatgagataatcctgagagtcttaaagtatctttcccatttaagaaaaaagtagaagcaagtattaaaaggatgcagtagtgttgaaagacagtttatgaaaaatcaatagcctatgctcagacatgaaagcttattaattctctagtggagtctggaacaacttcctgtgatcagacacattagtctccctgaagcaaaagcaagagggattattaaatactataaactgcctcatcatagttcagaatttgaataaacttttggttttcagagcttttattcctgatgttggacaaatcatgatggatctgtagtaattcatttgcattcttacgataagttattattatacccattttaaaggcatagaaaccgaaagaaaaaggagttgggtaacttcttttgggtcacacagttattaaaaggactcaggcagtctgactttacaaatcgtgttcttaaacatgatgctatactgccagtgtgacagacatgcatgtatatatacatacagacacatgtataaataagcatttagaactatttagaagtggatcccaaaacttctatacatttatataattgctttaaataaaggttattttcttaaataacgattgtatattcctctcatctttttgttgccagtatgatatggtttggctctgtgtcctcactgaaatctcattgtgaattgtaatcccctcatgtaggaggaagggcctggtgggagttgattgaatcatgggggtggacttccccattgctgttcttgtgatagtaagttcttacaagatctggttgcttgtaagcacatggcacttccaccttcactgtctctctctctctcttgctccaccatggttaaatgtgcttacttccccttcaccttctgccatgattataagtttcctgaggcctccaagccatgcttcctgttaagcctatgcaactgtgagtccattaaacctctttccttgattaaattactgagtctcaggtagttctttatagcaatgtgagaatggacaaatacctagtatgtattatgctttttattctccagattattatcaaagcttgtatttaggtggatatttaagaaattccatattttttgtttttatttcaggtctaatttataaaatattagcttatattgggaatttcaactttatgacatatagtttaaagaatacatagatgaccaaacacaaacactcatggtaaatcatgagaaaaaaatgtagtcaaaactataaaatttaagttgtaagaaacttgcaataattgctacatcagcacagaacttacgtttcttaaacttggtgtttgtaccctggaatggataggtggacagcagaattatgtttactggtgttcaccacataagttaggaatgcttcccaatatttttattactgatcttgcactttttaatttatccaaacttttgtgactctttggagcaatgactgataccacatttgaaccaggtatatactagagcttgaaacatctcataacactagaaaataaggaaggtatcaaagcttactaaagttctgtcacaagaattgaggagccagcttgaaatcactaccactagccagtctgaggtaaaataaaaagattgaaacaaaggaagtaactgtaatggactgaatcacataaaatatattttaaaattcttaatattaggttggtgcaaaagtaattgcaggttttgccattaatttcaatggcaaaacctgcagttacttttacaccaatctatagattataaaattgatatcgctgataatctttggatgatagtaggaaaccaacatattctgaaacctatagggaaagaaatatttaacacgcctttcctaaattaaccgtaactcaagataactaaatagctgaagagtgaagcctccctgtatttattccaactaatgaataaagacaaaatggtagaattataatatttccactgtgcaaaacttaataaaatggatttaggtgatgattttaatggctgttaatattccaaaaaatggagcactgaatattctgagcctcctaatagaagtatacgacacctacgaaatatttttgccaaaaatattcaagtctgaatcttatcaaacttctagtataactaccagtttacaggatattctgggcactgagagatgtgtgaataatactaagcaaagaaatctagaatgtaggactttctattatataatgtataaatattgctaggatgtactaatactctagtactaatattcaggtttctttaatcacccaagtgctgtgtgagaatgggagaggagagaaaggacttacagattaaagagacttaaaaggcttatcaaccaaaacacaatgtgtggacattattcagatccaaatttgaacaaatcaactaatatagttaatgaatctaggtacatgtgggtttgttacattcttctatctacttttctgtatgtttaatattttccaaagtaaacataaaaatggaatataggtttgtacctctacctgtattttcatctttcatcactatgtaagtaacaaattatgagaatttataaaagctggaaattgggttatcattttcattatttttgaaattatctgtaattgcattttatttcctctttgatgaagtaattccttaggcgagccattaaaaaaaatctcccattggttttgactgttgtattacatgtgatcaaaaatgaggtagtgtaatttgtgcgtttttgaaaatttttagtcctcactatccaggttaatgttgatttttttgttgttgtttacaaagatatatagactattaaagaagaaatttttatctaaaatatggtagtttaccatcattaaaccttctttgtcattatattgctaaagtcagcgagatcattttaggtcgcagtgatttttttacagatactaatggctgacaccaataaaactgaattttgctcaatttttttcctaatttttttgctattgccattctgatgctatatgcttcagtagagattcatatttgttatgccttcattatgaattggattttctcttttgtcaatatacaaattctcaattttaattattaatatatatcaattatttattaacagataagatgtgacatgcaactgagatcactacattattcataacaattatgactcttaatgttaagtcttaggaaataaacctgtcttagctttttctatccttcttctttaatttttctgtcacaatcatggcctgctctaatcagaaatcaattcttagctaaagaatacatgcttctgaattcctaagcttccatcattattattgacagtatttgtggagttttacttttttcttgggaccatggagagtgaagcacattttgataaatggaggtctgaactatacctttatactggatagtataaaagcctttttagctattttaatatttcaggggaaaagaccattttgtcttgggaaaattgaatgaacgaattttccataaaatgaaatgattaacaaaatcttgctgaatttcatgtttttatttagcaggtattgtatctaaaacgttgtcattgtctgtcagaacagtgttataatgcctttatcttaaattctttataaactagctgattcttgaaggggagggcagtatatttgcttacattcattgttaatttgaaagatggatttcaaactgtagagctgccgtgaaaaatataatgctaattgtagtttgaaaagcccagacaccttctgatagtacagttttacacccaagtaatttaaatcaaaatctggaaaacacttttttttcttttgatagcatatatgtaatatgccttaattaataggaaaatccacatgctggagaatggtgaacatgattaaatagattaaattacttttcttatactatgcattaatagctttctcaaccatgtcccagcggctgcagcacattgtgctataccttactgaggaaatcgcctgatttttttttttaatcagtcttcactatcttgccattttttaccattatcattctaacttagtgaaatcctggttttctcaagtgtctagtctttctttgattttgatttcacatatcatacacatcagttatttatattttatcttgttaatcaactaatttcttcacatattttatttttcttcccaaacacatttttgttcaacttgaaggcaaaaagtatccttggttctggatcattttcctcatggttctcagttgtagagaggtggaagacacatgacaaattctagtttaactggattctgtaatttaaaaaaagaggtgttacagagtcagtcctgcagatgtttgagttccagacccttccaggcaggtcaccaggtactgcctctagacttagatgatgtcccctgataattctgtcactcttcttccgcaagttgctccccctttgtgagtcacatcatataaatgatattattttaatactttctctgtcacgatctgtccactctaagcagaccttatttatttttaatcacccttttgccacgtgggtctgctttttctcattccttttcactttatcaccgtcttaggggacttaactagccaaatggataacccatttccttgtttttctgtttccatgagcacccacacactgctcagaccctttgatttctagcattaaacttatcaattcaacctcttcctcctcactacattgattttttttttttcctacccagcctcattgcaaaacccaattcctcagtctctctaagtttttctcctttccctaccctgtcaggatctgttcttggactatttcaccagtgtactcactccagctagggtgcctctcccctgatatccctcgttttgtcagacttcattgaataaatcccacaatcaatgtgacctgaagtcctgtcactgtgctcattggttctagtagacatctagtttaccatcagtactttggattcatctctttccacttcttatttctgagagcagctggtggctctgacgacgtcccattctttaaaacatctaaccattctcttaactctcagctacaaatcttccctttgattttagtgagaaaaatcaacggcatttaatgttaactccacgattactgtttctttcctcaacaaaacattttttagaatgtcctcccttctaccttcttcctgaccttgtggcacttacatcctatgccttttcagagataatagccccttcctaggtctccttaatctttggtgctctggtctctgcagggaccttttccatcaaacaattcatcttgaaatttttatcttcattaaagcagccacaaatattcatattcttaaatctcatcaagaaaaaaaaaccctttaatttgaccccagtttccctgattatactctattttattttttcttcattagtgaaagtttcaaagaattgcctttttatcattcttgcctctatagtatttactcattaatcatctgttattctgtttccttgatcactccattcaaacttcttttttagaagtttgtaataaccttctagtagttaaatctaattttcctaagataccacgttctctacagtggaagcctttgtgtaacgtaaaagaagcatagatttatagaatctttatttgaatgttacttatatttatgctaccttctgacaaataggtgtgtatatgtgtgtgtgcacacttttttttttaaataactatctgatctgcagttttcatctatgaagaatttatggtctttcctactacttcttacagttgtatgtttaactatgtatgggatctcttaccatttttagtgcctcatatttagtaataatctactaaagagatgtttaaagctatatagataaagattaaggactgtctttaagaatgccttaatttttctccccctttctctcctacccttgacttaattttttgtggcaatatacattcataaagtaaaatctgatagagcaatcatatgggattttaaaaatatagttccaagtacattactaatggacaaaaggaaagctgaaatccataaaatggggtaaaaaaaactcctcctcccttttttgaatttttaaattttttatttatcttgaaattctggtttaatttgcaacagatctagaaattcaagtcaatttaacaaacatttgttgaattcagtaaggcttcacagcctgaaatatcaatcaaaattacttttttttaccttatattcctttaatattttgttttagtcctacaatccccttgtaacatgatatgctatatttgagttattgtcagtaataataactgacattttaaaccataattgtctttgccaaatactatgcatgctaatcaccttacatactttgactaatcttttataaaaacatgaaacccaaaaaagaacattttcatcctcctataatgatgagtaacacagaatgtgtaaataaatttccccaggtctgtagatagagccaggatttgacattaaatctgtctttttcatagcgttgcccttcccttcttcagtagttttatacttagacacttgggacacctcaaggaaaatgcgatatccaggaggaaagggataaacagatgtttatataatattataacagggcacattttcaaagcatgaatagcagtcagctgtttgaaagtgtcaaggaagcagagaagtcttgacagaaggcgtaacatttggaatgcctctaaaaagatgagcagggaaggccggggagggaaatgatggcatattcccgagtgagggaacagtgagttcaaagtgtgggcccttcagggtctgctgaggctagaatgtaggacatataccaatttattaggttttacttgtttgtttcataaacaatggtagagttatatacctcctctcttgaatccagttttgttggaactgttcatttatttagcctattgaccactatgtatttgtgtgagtcaaaaggaataaaatcagaaatgattttatgtgatattaaaagctttaaaaagcaatactaagcccagtgcagtaattatagatctgtgaccccacccccactcttacccctggagttttgagtctggtttactgctatattgattgtagctaaaatcacaaccagatccgctaaacttcttggcattccttttaacccaaattgatactaatgaatgtcttaagactacattgtgcctccagctcatgagcaaacattatgtctgtttcatcatccagtagaatgataagattcatttagggttattgaggaagattctgtaattgtaatgaaatcctggcatgttgtaactctcagaacactgttccccatagtgaacatctacaattagttggaagtaatctcagttctaaaggccttcagcagtgactacctcttctcttacctatcatttgcatgcacataaatccaatgctgatttagtttggcaggaacaaggaggaagagaggagtgatgagagcaatatgaatgggcttccatatatcaaaatagaaagttatattacaaacattatatacagcttccatttattgagaccttaccaagtgctaggttctttaccaagtactctgcatgcagaccttatctattttaattctcacaactaccctgtgatgtatgtattattaagcccattgaaaataaatcaagaaataaccttagcaagattaggtgtcacacagtgactactagattagaactggactatatgcctatctaattccaaagctgtctaatgcatgttagcaacattacattgtgactgcaatataacaactattcaaaagttaaaatatttttaagtcagacaaatctaaaacaccattttagtacatttcaggtttaatatatttattctgttttagaattatcaatattattattatttcattaaccatgatatgccatattttctttattattattattattatactttaagttctagggtacatgtgcacaatgtgcaggtttgttacatatgtatacatgtgccatgttggtgtgctgtacctgttaactggtcatttacattagggctatccctcccccctccccccaccccacgacaggcccccgtgtgtgatgttccccaccctgtgtccaagtatttccgtaaagattttcttattcaatggcagtctacaccattatatcaagcagactgatttggttcatggttctctttgattaaaatgtatcagtcatttatgtaagatatcgtcaatgaattccccttgaaatcatggaaacaggtaattaaattctgtcattttcccaaactttggctttgttcttttcctggaaaggcataatatgatcctagaataaaccaagtctcattcccccaaggctaattaacatgcaaataaattttctatacactagtgtttttactaagtaaatcattgtagctggacatatcatttttaagcagaaattttttttatttttgtattttgataactctaaaatgttttaaaagtttgcaaaggtaagaaatgaaaggctaatgtattctttttgtgcaatcagccagtccttggtttctgctcggattggtatattgaagaaatgctaatagtatatctgtaacctgttaaggaatatcaagtctcttcaggaaaggaataataaaatgctaatgatcagcattaactgtctgaattggaagggattatagaggaacatttctgtccttttcctgtcaaaagaggatcaccttctacaataatcccaacccagccattacttataccttccaaattcatgctgtagtagacattctttgagggaagaagtatatattattattattactatctggaatttcataatgctttgcatagcattttacataatatatgctaagtacatttttcaatgaatattttaaaattccaataatcaggaattctctacctcacaaagcaaccctttttatttttaggcagcatctacctacttaagtaaaatgtattctcctcatccttctggtaccaaatagcaaaactctgattcttctaccatgatggccagcacatactcatcattcaaataagttcatcagtgcccctcttaatatatgacatagacaagtgaacttcacatgctgtggttcaaccaaatatgggctgtgattgtttttcacctccctttttctggtcactaagattatattcttggcagccttatcttagctcaagtttagcagtcaactcaaattcttctgtggtttttttttctccatcacattactatcatacaaatttaccttttaaccttctccacaataagaaagaatctgtacattttaagattactgaaacaggggagaaaatagagcaggcagaaaagcctttgctttattggttggagagaaggaaaggagacacttgtaaacttatattaatcatttttggtccatcagatactttattttgcagagcacttcctcacttctcagtttttattgttttgttttatcctgtgttgttttcgtatgatctattgttgagccagggtatcctcatatgtacttgtgtgatagagttttaaaaacatttgcagcaatctgtggccaaccctcacatcaatgacatgctgctgataggaagaagtctctgtatgagtattgaaaacactgagatttacttattggatgcattttatttatatggtttgattcttatttttaatgattttttttctattttacaattttaagggtaaaaaatgtataaatatttggaaatagctacatccatggaagagagacactgatgaatgagtttgaatatgaaaatctgatggtctatcctgaaagaagaattaaagttttgctatttagtaccaaaggatgattaatagtttttctgaaaccataaaatgctcctggtatcttctaattccaagttaaaaaaactctgtaaaatgttattgtagctatttagctttaagcagattattattttaccagaatatttaaacatttctaaatattgtcatctttattcataaatgtttccaatatctgttcatataatctctgtataaatttcacatactatacagcatgcatttatatatggtaactaataatatttactacttagaacacagttagaaatgaatgcaatattcattttgtacaaagacaatatctcagaagataacaggagagcaaactgaggtagaagaatgagctaattagattggaataagagaaatgttcccactttagttctccagtgtctgttttacagactattcatttatattaaaacatgtttctaagtgaagcaattatatgatacttacagattttgcaaacaagatgtgaaattgttgagtattatacactgctccacagaatgattttaaagtattaattttgtaccttgacatggtgtcttatgtgatatttgcagattagaatgcaaataataaagttttgccaaattggtatgtatatatatataaacagttttaaaacagtatcgtaggctgggcacggtggctcatgcctgtaatcccagcactttgggaggttgaggtgggcggatcacgaggtcaggaaatcaaacatggtgaaaccccatgtctactaaaactacaaaaattagctgggcgtggtggtgtgtgcctgaaatcccagctactcggaaggctgaggcaggagaatcgcttgaacccaggaggcagaggttgcagtgaaccaagatcatgccacagcactccagcctggtgacagagcgagactccatcacaaaacacacacacacacacacacacacacacacacacataaacacacacacacataaacacacacacaaacagtatggtaaaatacaataccaacaagcaacaaattaggtaaagaagtacattggagttttgaattttaaaatcaggtttattgaaatatataaagtaaaattgatcatgttagtataaatgagttttcataaatacagaacatttttattaccccaaaaaatattccttcatgcccctttgtagtcaaatatcaatgtcactagcctttttctctcccatcctgcagtgccactgccagaaagggattgaaccactaaccctggatctgctggaaggccctgatttggcttatctagggaaagggctgcttctagacccttcaaccccacttagctgtctagggtactacacctgacccagatgtaagtgagattgcatttgtacagagaaagatggagctgccatcaaaccaaatggaggaagaagcattttccagaatatagctgctgttccctaagcagagacttggagtcctgggaacatgaagtaatgggtgcccacattatagtaatttgataaaaatcagttaataactttcagtgagatagttaaaaatcattttttaagatagaaatgacttcttaatatgctaactgtaagatacgtatgttgtaagataatagaatacacattatacctaatgtaatagaaaatattcaaggcataaatataatctgaaaaagcttatggttaatttttttagtaagtaatcttttttgatcatttttaactcctcaaaacaatacacttggcactgttgtttttaaatctcaagaataaggactcaattatttcttcaatttgttttcttcatattctgaatttcacctatatatatttattttttcatgggggagtacacaataattcagttttgaaataaattaaaataaactcagatccctttgtaaatgaaggagcattaatgtctttattaaaccacattattgaagcaagattgacatgtaaaagctgtacattttaatatacacaactttatgagtttggacataagaatatactcatgtacccatcaccacaatctataccataaatctctccatcagctccacaagttttctctcaccatctacattattattattattattacgtgtgtgtctgtgtgtgtgtgcgtgtgataggaacacaagaactaccctcttaacaaatttttaaggaacagtagtattacaaattcacctctagctttcttgaaaggcagtgccttttaattgtttatgccttcatttcattaggagtttcttctgtctaaaagcttattctgattgattttcccctaagcagcctaaaacaattgaaaaatcttgttattgtgtagctgttggaaagtcaactttgttttaaacaccacatctgacagttaaaatttactgtcaccacagtattgcccttcctgagagagatttgttgttgatttcctccctaattttgggtcacatggtagagaagcattgaacatatgttattgtgacaaaatccacacatggatatttatgaaactatagaaaccttttgcagttctccagaaacctgtgatgataacattctagttatctttggttatatttttggtgcaatatatgcatttattcagtactattaaatacctactttgtggcaagtataatttaaatactgagaactcagtagtaaacaaagtccttgtcttcacagaattgtatattggagaacaagcactacacaataattatataagaatgccatgtgaattttaagtgctattgaaaaaaacagtgctaggtgagggaatggaaaatgatggcaagatcttgttttgagaaagaagataaagtggtcagaaacatcagtcctctctgaggtgattactgaagtgaaaaagataagaaagaagccatgtgactctctgggggaggaatgttccagcagagtaaacaacatgcattagacctgccatgggcaatatttgatgcagtagggcaaggcaactcgaagtgtgctcaccatgttgatcatttattacaaatatacaacaagatttaaagcaatgtaatgtaatatttgaatacattgaactggcaattgatatgagttgcatgtcttttttatttcattatttggtaagttatttttattgtattttacaaaagtttaggctcacactcaattcagggaaggggcttgtccttcactatagataatctgagaagcatcatgtttgaggaagggaagagggccacctgggtgagttaggaaagagaagaccttggttcacttagctgtggtgggacaatgaggatattctcttctgaatgcaaaaagaatcaagctgggctgctaaaagtgagaatgggatgaaaagtaattaagagaggagatataaaatagagtaaatagttcaaggaagtagagtttcctgactgtggggagcacacacctcaggtttgtagtcaaaaattgaatgtgaactagtcattatagttatacgtttgtcattgttgttaaatccagccactttcagctgttttattacaagtgcagagtaggcagaggataaaatttaactcagatttgggtttctccagcaaaatattaagaggggaaaaaatagctgagagtttataaaaggatgagattagaatgattcacttggaatctaagctggataaagagtgaagtgaggacaggggatggccaatgaaaggccagcagactagaagtgccaatgaggccagtgaatccctgaatgggagcactagagcccatgagctgaaaggtaagggcaataactctgtgaaagggatgcccaaattggtgtttggaaatggtgcaattattggtaatgactggggtggaaaagaagtcatctcattgtggtaatattctaaaacactaatagaaagcctcattttcagacttaatgcaggtcacagtagtattattatagtaccatgttttagatgaaattagttaccaccagaaataaaacattcatgtattatgatatttagcatttcaaatcggataattacaaaggttttcaagtgtttttcttaagtgaatgtatagttcccttccttttctatatatggtgagaggtgaacttctttggagaggaatatgtgggatgagtcaaagtactgggagaatggaaagggtggggagttgctgagttattatattagtgtctgctatcttgtagttcaatgtcaatcttttgctgttgcctttagcctctcttctgcctggaaggtgaaaagaaggcatttatggagagatctacattatagaagagaaaggggagaagtgttataagtttcaggaccaatcaattttagacaaactgttgaatatttcaattcctttaacatggatgaattttgaagagtatttgagaaataagtcaatattttagatcaaaggccataaatatcttagttatattacaataatttgtaattatgtgaagaaacaatgtaccaaattgtctctacttggttttggtttaaaatatagcatgccctatatatgatagtaccaaagctttcttttgtgtgtagaaatgcattttatatgcatgacaccaggatacttagatgataaggcattgcatgaatagaaggacagtcactccttattaaaattaatctttatttttgttgaaatgtaagacttactggtatttttttctttacacattctaattttcttgagtccacttctttatttaaaaaacttcacatttttgctttaaatttttatctgtaagaaatatgtttgcatttggaggagacatgtctgtgaaaaccacacgtgtgtgtgtgtatatatatattatgtatatattttatatatacccatatattttacacacacacacacacatgggagaatttgttttcttaacttccaatggaatgctatacggtgcttccaatgtttgacttgtctagctgaaagctatgatggatttcttcatcctagatgatatgtattccctttacttcattacacttaatctatctgtgcaagatcttatggcctgtggtagactttatactctaccagacagcttatcagtttctttgcaggcctctcaatttgaattttaagtaaaaatgaataaatttgtgttgcttgttgagactttgttctgaaaggcttctgctctctgattctagggtgataactagagaaaggaaggtcatagattgtcatttacaatagctgtattgtatctatgtggtctatgtatatatacacatacatatgcatatacttgacatatgcatatatgtatgtatatgcacatagtgaatatataactaaatgcacatatacattaatgtataatatgtgtttaaggagtaagagaggagagctggttgttgattatcagaaataatttgatatttggaaggaagaaagatttatcttaatttagatggggcaatatattgtaccatctgctgtttaaaaacgaacagtcttataaaattgaaagcaaaaccagaaaataatttaaatattcttctggcttctatatgatgtgaggattgaacacattgctaaattcatcccagtgggtcaaaaagggcagtttgagaaacccaagcccaagaggaaatggaacaattttataaacaaagtaaataaatataaaatgctcttgctatcaaaattgagttaatacatctctagctgctcaaaacagttgctttaacacataatgaagctgtttaaaagatagtcaaaatgctatacctcaggtttgcactcagatcattttttttttatattgcttttgctgttggaggactccatactccaaatctcaacaggattttaggtgaggagttttgttttgtttatgcttttgtttttctttccaagttatatgtgaatgactaaagtattctaaaatctcctcacatatttatgtcttttagaagagcttatttcacaatgttctttgtaacttttatgaaggtaaagatataatgattcgttccgtgttaatctataatatatattttttctagtgtttgttaaaatatattattatttgtcaataatttgtactgaaattttatgtttcttggtcaagactgttcccctgacctttaaggaaatttgtattactatagcagaatacatttttagttatacattttcaaggtttcatttacagtacaataattttgaacactatttaataaaatatcaagcaaaataaaataatccagatcttcctttgtactttagttccatcaagaatcaactcttcctgtgcataaatttttctcaccaatgaagaaatcaagttgtgtttaataggtagtcaaaattcattatgtgtaaaggtgcaagttattaggtttactagaagaaaagagggatacagagatagtcttgaagccatagaaataattctcccttatacatggtactgaacaaagtcttctacttttgtgtaaaagcaaaatactgtagtcctccttcatctttggataatgaatcctccacatttaagggatattagatcattcctaccaataaaaaactatttatttaaaatgaaaactaagcctttgtgtgaatttaaaagtattgtctagtgtgaaaactgaggaaaaattaagtctgaaaagtcaactgcttatatctaccttctttattttgatctggccttttcttctgaaaatgtttatctgtaaaatggacatcctgatgacgacaatgatgatgataattctgagcataaatccagtagttcaaataattcactctttcttgaaaaaaaatttttctataaatttttgggaaattacctacgtacagatcagtagtcaatgtattcaaatcaattttgttgcaagaatcagggaactaaagacactataacaattcaagctagggatggacctggtaaagtagaggtgttgtagacaagctcctgacatttattatgagatatttgactactaaaaagcattccttgaggtatttatttgaaaggtaatgcttcagattaaaggaaaaaattaatgtttatatatttttttaattttcaaaggccacttgtacaaattctcttttacccttataggattttaaatacattctccttaatttgttgatctgactgtaagtaatgccttatgcttagggttattcttcagagtaatgtaaaataacatgttcagctgtcataaatgttattcatgtaggttgccaggtatagaatgaattctaaataatgtgagtgctaaggagtctggaagcaatgttgcaacttgtgtatctggatgcaagataggggtgcaatagcattttatacaggagatgggaaaacatctttctccattgcagaggaggagatggaatgacagtgtctgagtagtccaagagtgttcccagcatttgttggcaccctgctttctggtgtctcaattttctttttaattaatcaacaccagtgatttggattaaaaaaaaatgttgctagtgaaataaaagcaaaaccttggcactgttaagtatagaattgaaaccaagttattagtatctgacagcatttagattgggagaagtagaacagagtctattctcatggactcttcagtactgcgtgatttactcagagctcctggatgttgattctgaagtccagatgactcatcagaaactggcaatgaagggcaacctggatttagatatgtttgtacattcagattagtgttagaaagagagaggcagagattgatggagagaaaaggggaaaggagaaaagagatttattgacttcattgactgtaattaaaaggaactctgatcattcaaaagaccttcctcaaagtttcacacttctttgttcatgttaaaacctgtttttgtatctaggttctcagtagggtacctttaagcaaaaagaagagaggagccctttaaactatagtttcatgaaatttcactcattttatattagtgactttgtgtgtgtgacattttattcttaaaatgtctgagatagcttttacctatcgggctctcatcacttcacagatggactattgcagctacttttttaatactgtttttaacattcttgattcctgtactcagaacctgcagaggtttaccactgcttgcaggaagttcaaattcttcatccaatgttctccataatgttgttcgttctccataatgttgttgttctctgtccatctaattttgcctcccactgttttctgaccagatcataaactcctgctagacatattctctttcattcctcgctgtcctctgacttcatgctatttttctctaggctgctttagctcacattattctcccctactctgaactttcactgatagattccactgtgtgtattccttaattgcctatacaccatacttcattttattcacccctcttgggggtgcatagaccttgtcattttcctttgtatgtcccatgtgacttgtttgatgatgagtagtgctgtctgcagagagagcactcaagtgattatagaacatgtccattaagtttcccaaatagaagactctttatctcctattctgccactctgaaaactaaacagaggctgtgaaaggctcagtattgctgatgctgtaaagacaggacacctagttgcttgaagtcccagatgattgatagaaatagtttttgtataaaaaagtgaaattgattagcaaattaaataggaataaagacaagtgagggtgatttaacttaattgaagaagagattagaaaaatcagagctgtttttaaaaaataagaataaaaaaatcagtgtggtgaacacaccaaggagactttcagaggaaggtttagataagtccataggacaataatctttaaggtatagcagaaacattggaccttcttgaataaggaatgaaattgtcacatacataaatcagagttcaagaggattaccccatccttgttgatcagtgctcagtaagccaggttgcacatctattttttcccgttgtgagacaggaaataattaaaaagggaaataatcagatttgtaacttaataatatggtttgtaaaactattttatattcatctggggctggccagaaagccatctctactaggcatgatgaaattattctgaccattctccagtatttatagtgaaaatacatgttcagtatctcttttgtttcataatatctaaacaagaacacgtggattatttccatctttaatttcgggaccaggtatatattagctcttttaaggaagtgtcatgtggcacaggtccaaatacacatccttccttgataataataagtctttatttttataaagctgtatattttgtaagtcaaatatctgtgtctttctaaatatgtgccggatgtttacatttcaaatgggcaagaaaaatacctgatgtgggatataccagttttgtggggtgagcttcatttatttatttatttgtattattacttgccattatttgaaataattcataagagctatataagctcttcctttactgcctggaatgtttcatatgacctactaaattttgcattactgtattattttagctagtgggaacatttagtataattactttggctattctttattagattatgagcctcccattacttctaaaagactatcttggatgctgtttgggttcagtaaataactatgtattactgcaaaggtatactgagatttctattttaagtggtgtctggctagcagccctggacacaaccttccaaaaatttccagtaaattgactatgaagacacacaaagagatatctgttcgtagtatggataatatagactgattgtcgcttactgccagaatttgagaggaattctggaattgttttcctacatttagttacataaaatttcaaaactatagcagttaagataattttctaatggacacttgcgtacccacctcctgtatgttactattaccattttatcctacatgcttatcccccactccattgatggaactagattttcaagtgcaattggtggcttacctatgtacacttttggaaatagagctaagtttgccctaaggcaataagtaaaaagctgcatggctcaaaataaaaggtttctttaaactgggaactggaagctactcatatattgtataaattttgcttttcaaacaaagcaaaccccttctgcaagtacctatctgttttagtatgtattcagaaagtaattaaatgagaaatagggaggaggggacatggttatattttgtcccctgcagagtatagctctcacaagtggaaccctacaagcaaaacagataggaagaggctagggtagtggtttatgcagcagtgtctagttttgtacacattccagcagttctgaacttagtgcactgggctattggagaacaataaggtccacttcagaactgtggaagatccctagaggatagattctggggtttggatagaaaccatgtacgtggactagccatccagctctgagcaatggattcggccattacagaagggcatatgaagtgggccaaagagtgaagaatgcattttctttgttggctatcacccaagttaagtatagctccacccttgtccacaaatacaaaaacagaaagaaataagatagtggttttaaaacaataaaaatacttcagaattatgctacaacagtaaaatcctaatgaaaatacaactgcatctacagtgttttgcagacaggtacctagccaagaattttataccagattaagtaagtcttcacatgagaaggcaacaaaaaggcattttttaaaaagctaaagttgaagaaatatacccttatacaacttcataaaaaaatatttgaatcaaaagtaagagcctaaggatgccattttattaaatgaattatgcatcttcccttacacattccgatcctagatcacgaaaatttagatgggatgtgtgtttgatcagtaaatagcgcagctcagggaagcaccttaatccctatatgtaatgcttttctcagatgttttatttcttcattttttgataccatatgtatttgtctgcctaggatgccataacaaattagtacaaactgggtggcttaaacaccatggttctggaggctgcaagtctgaaatcaaagtgtcaggaggtttggttcctcttaggcctctctccttggcttgcagatggccactttatcactgtgtcctcacagtgttctttcctaagtgtgttcacatcccagatatctctttctcttcttatgggacaccagagatactggaataggaccccaccctaaaaacctcatttaactttaatatctccaaatgaagtcacattcagaggtattaggagttaggttacggcttcaacgtacgaattttggggagacacagttcagctcataacatcttattcattggtatatctgacgacttcttaaaactctaccagatgctattcttttcttgtttttttttattatttttatttttatttttttttattttttgagtacttgatcacaatggccaacctctaaatgtaaacgtgattgtggcattcagggtaaacccagtgcacatctcatagacttagcttcactgttataaatcaacagcatatggaattagcagcattttgaggctcagagggcatagggatatcctagtgcaggatttagctaagaaggccttgtttctaaaacagagtgaatggagcaaagtgcatgagaatgcagtggagcaggctggccatacacctttcaggctcactccctaggctgaatctcaaccacattgaaaaacagttctgggaatccccaagtttcatatacatgtgataacaaggcaaaagtgaacagacatttctgttgtacaggcagcataaagttgcttagacacaacaactccttatatctaagggagccaaagtgaaaggtggaccatggcacagtggctttaccaaaccaccagggaagagcaccactgctcttgggtccagccctctccttcaaccagtcctccagctggtcaagaaacatagttcaacagtagttcaaggaatagtgagagtggaaaaaaggaaaccccacatattttttgtgagcacacatcaatcatggttagaccttgccttatctaagactaaatagagaagaaaacaaaatgtggtgatatattagggtcctccagagaaatagaactaaattattaggagagtgtgtgtgtgtgtgtgtgtgtgtgtgtgtgtgtgtgattgaatgattaattttaaattggttcacaagattgtgaaagctgataagtctgaaatctgcagggcgtgccggaaattcttgcaatagtggatgttgcaatcttgagtctgaaggcagtctagagtcagatttcttcctctactagggacctttgtctttttctcttaaggccttcaacttattggatgaggttcacccacgttatggagggaaatctgttaactcaaagtctactgattaagtgattgatttgtttatttgttggttggttttaagatagggtcttactctgtcacccaggctggagtgcagtggtacaatcactgcagcctcgacctcttgggctcaagcactccacccacttcagcctctcgaatagctgggactataggtgtgcaccaccatgcctggctaatgttggtattttttgtagagatgggattttgtcacatcgcccaggctggtcttgaacccctgagctcaagtggtcagcctgcctcggcctccctaagtgctgggattacagacatggtgagccactgtgcctggctctgcttaagtgttaatcacatctgcaaaatgccttcactgcacacccagtctaatatttgaccaaaccctgggcaccatagcctagccaagctgacgcataaaactatcacaggtgactataaaatgttctgaaatttaagttttgaaaaatacagttatcacaaggcagagtagaacaagatgtttaacaaatctctctagaaaagatcatttttatatcatcagtagaattcaaaaaatacgggctctgagacaagagataagacagaccaaggagcagttcaaactcaggaataatttttaaatatgcgcatgtcctaagaaaagctataaatacataagtatgtttgttttgtattatatagttgcatttgactatggaaatggaaatatatccttcctcacaaatatagtttattgctaattattggtaaatatatttatttgatattgcaataatagtattattagacccacttagggccaataaaagctcataggttgtcaaaactgttttgtcactttggttgcaaggggcagaatttgattcttaaaatattggaattttatattcttattataaatttgggggaaataaaagataaggagttgccataaatatgtgagggcccacaacatcagtgtatttcttgttgtttaaaatctttctttaggctaggtgtagtggctgatgcctgtaatcctagcacgttggaaggcaagacgagaagatcacttgagcccaagagttcgagaacagcctgagcaacatagcgagaccctgtctcaggggaaaaaaaaaaaaaagcctttctttagttattatttcattcagatagctatgaaagtatttttggtttttgcttgcttgtagcttttctgttttctaccacacaaaaaatccaattttaattttgggtttgtgaaatatgttttatcaaaatataagcctgatgtttcttatcttccaaaaaatttaaaaatattagctcagatgtaattttgatcataaatgattaacatgtaaacttaaattgaatgtaaccacttcatatggatatttcaaggtaaaaaatgaaatctaaaatatctgcacactacttttaaaattttgtccataaaaatgagaaataccgattccttatattctcaaatttatttcatcatttatatatgtcatatatgaaaatgtgttctttttgatatttactttagatatcaaaataatacaaattttaaacctgaaataaaccgtagatatccgttgtcaggattatatcttataagtcacatcattctattcatcttgtctaaactaatattgttatatagtatcacacaagaaaaaatcaaactataaattaaatgtcaaatttctgtttgtttttcaacatacagttttaaatagatgttattattctctttctgtataaataccctgagcagaaattgtcagcatgcacgtatcttttttatggtggaatttttgactaatgagtttttgttagaaatgtatcagttctacttcattttatagttgaggtgttcatatgagtcagtctcagtaatttttgagtgactttctgtagaaagttgttctctaactagaatggaagatgctgacacctagatgttcaaatggggctgatggaaaaaaatcaggacaattttgtatcttatatgggcaacaaagcattataaaaggacatgaaggatggtttgtcatatccattagtttttgccgttttatctattagacttgcagtagcatatgtagaacacaggttgtgtatggtgggaataattttgtggaggatattatgagtatgatattcacatgctaaatgaaagtcaagtatgccataaatttaactaatgtcacttatgttttgttcacatagtagtggtgtcatcagcgtaatacaggaaagatttacagtacagcccaacatgactgctgttctctagtgtgggccccggtggggaaagggagaatcagaggaagagactattactgatggcactagttttcatttttaaaacacacagcctgggctgggcgctgtggcttacgcctataagcccagcactttgggaggccgaggcgggcggatcacgaggtcaggagatcaaggccatcctggctaatggtgaaaccccatctctactaaaaatacaaaaaattagccgggcgaggtggcgggtgcctgtagtcccagctactcaggaggctgaggcaggagaatggcatgaacccggcaggcggagtttgcagtgagccaagatcgcgccactgcactccagcctgggtgacagtgagactccatctcaaaaaataaaaattaaaattaaaaaataaaacacacagcctgtaactatttgaccttttgtcttttatagtattttagtgtgcttttatttcattttatttcattttactgagcattttatttcatagctttaggtacaaatgtggaaattttaggagcaaagcagtttgtaattatttgtctcaaaaaattgatttgacctttaaagacatagtttttgtgcatcaatgggactaatttgtttaaatagtttataaacaaactattaaccagtatgatatttttcttaaagagatcagagccaagaacaataacaaaaaagtgatgactcatttttcaactttcaatttatgttacaagacattatcacagcattcattggctctaatttgacattaaataaacacagtgaaaaaacaatctttgaaaagttattcatgctttcgtataaacagagagatggtggtttggagataccccttttaaaactgagcctcgttaatttaaaacaagcacaatgatacaactgtacttgacttgaaggagggcatattgttctgcaggcgtcctaattttacttctggtcagagggacactggaagattttcagccagaactgcagtgagagatgaatttttattatatgctgagatgctcagatgcctggaaacagaaaagagctaattttactgttgaaaagtagttaataggctacctgtttccaaatatgcacctgccatcccccaccactaccatcccaagtagatgcagactagagcattcatagtggtcgttcatccgatgtggctccgcatagatttttattaagtcaggcatggtttgtgtagccctccccgctcctggaactgatcacccatgttttttgctaccagagaagtagtttttcaagcaacacacagcttgtatgtggaagatttccaaagtcacaattgcttctttatcttccagtgactttgaaagaaagccatggcatgaatagaatgctcaaagctctgtccctgcacaatctgtagtcctttatttcagctatgctttttactgcttcttgggaattgatttttctcttcaatgtaccacacccctttcaattctctctccttaaaatggaaaagagaaagaaaatggtgcacaaggtgtctgagaagtagagcaaaaagtagacatgtgtaaatccataaggatatgaaatggatggaaaatataagacacaagacaaacaatactcattcatgcaacaataaattatgtaattctggagtggaggagctagcccagaactttgcaacattcagaccaaatttcttagactataattcagttattcaatttttttttatatcggtacttccttattccttaatgtgtctgttttcagagccttgggtatctaaatcagaggtgaaatctctccgtttctatgccaaaaccattccattttctggtcaaatagtccctgagtgtttaatgtaattgccaaatgaattttcaaaatatgccttggagagttacaataaaacattttcaaggctcacaagtcttacggtgatcaggattagtttgtttaaccagcatttcctaaatgaaaccctttcactcgataatgactatttttatctcactaccttggattaatgtgtagatagtggactgtacagattcaaaagataaaggaaaaaaattttaggacttagtaagagaggaatatagggttaggtgagcaaggcttctagatttctagctcgtaactcagtgggaccattcactgaatgagacactggagtatttttttagggctttcatatatgcccgggcaacaaagtatgtctcgtattcttgatttgaagaaaggcaggctttctgttcattgcaagagttattattgagagcctatcctttgagaaaatataatgtttgcagaaatagatttgatattctagctatgtaaagaaatgaaactttaaaatgtgagatagaaaaattataaccagaataattagaacaaattacattccacatcaaggcaccttactgtttagacttaagcaattatttaatgtctgcagtattgtcatctgaaaacattctatgacttagagaaaatataccatatcataactctaactgtattattctatctttttgccaagcaatacaagcagagtagtacattcagaactggcaagatgattgtctgaatgtgacattatctgatgacactcagaaagcctttaaacataaaagatatagagaaatgcttcattgctttccttggatggcattttttcctttcagcctaagcaagattaatgttctcaactgacatgatgacacatctagctgtgaaatgacaataaagtatatacaaaatgggagtagggacatgcctaataaaatgcaataccttaattttttttctaaatactattagtttgagattgttctgaaggtaatgatgttcaacttgtaaatgtgttgcatatgccattatgtttatacattcgtctgtacacactgtttttattaggagtgatatatcacctcacttttgcttgactcctgtatctcagaaaagtgatggcatttcttattctcttcagttctatttagcagacatttactgagtattctgttgttgttgttgaaggtagtgtgcaatatgtttctaatatgaatgtaacaaaaagaacctgagaatatcaatgaaatttaggtgaatacttaattcctggtgatcaaagctaatgggtgttctaatgaaaaaaagtctagcactatcatggaataacagcagaatctggagcaataaggcaagaaataattttatttttcagacaagccacattattaatgaaaacatgcaccacacatgaataacattggaatattacctctttcttgaatagcagtgatgagatggcctactctgagaggtactgaaaaatcagttgaggagattattgagcttaagtgtgtaataatcagaatgaaaagaaatacatgtagtcagaattacaagccaacttaaacagataattgataaggcaaattgtataatattcaaagcaagaaagaagacctagaatacatcaagatctctatctgtacaaatcgtggttcacataagcagtatgtgcaattagtggaaatatgtcctgatgaaatcaataggcctgtttaggccttacttttcaaaatgggcactagtaacatctttgatagaaagaattcttgttgcagtacattgaagtattggttcatgtcatttctgtgcagcactcatttatcatctgtttcaaatgaatctttttggtacttcatattagcttgtgaacgtacaaaagtatccttcctatcaagtaactctagcattagaaaagaatgactgcctcttgagagttgagtgtatagcttgatttattcatctgcaacagaaaaattccttcaaaagtttttactgtatcttaaaattttgttggaattctgtattctttcttctggcatgttattgtgatttctaccttaactctttagaatccagaggaggttcaccagagttttcttgtggtttctcctttttcctgtgaatacacaagtactctcttttgagaagcacagtattgtgcagattttgctctcaatgaattggtcatgatgtgccaaaatgatgttcactcaaagtgttctgggaatcaagggaagagaattgacggctgtacctgtgtccatttgaagggcaatttggataggagtggttttggtaaaccaatgaggaaaaagaagagggtcttccaagctgaagcacagtgcctatgcttgtataagcagtgaggctgggagggtggggtgagattctaaagaagatggaaagatgactcgagatcaccttgtctgacttgctatgcaaactacagattttgatcctcatgtattacatgtattactgattctttaacattgaaagctactttaaaaaatgaaattagtgtgaaagttcaataaatactttataaagatataattatcttaaaactttataaaatttccttataagccagtaagtgaaagagtattttgataaaagcaaaaactaaacttcattggttttagatgatagcagccatcatatattggccttaacttctcattaatttctacattttgttttggtttcatggtgtctggaaaatccttattagtataaataatacacatcattttaaaagggtatattaatagtttattttgaaatcacaggacagtctcttagtaagctgatccacaggcttgaaagaggaataattggaaattattttaatgctgagtcattaagaaaatttaactgctgcttaccatgcttaccaggcaaagagtttagtttagatggagtacaccaatcattattgaaagataatattttgaagtaatctcagatatgtcaatattctgcttagtcagacattgagtttgtaaatagccatttttcctttagtttgcatgctgcgtctaaaaggcaagttctagtttcatcaaagacactctccctacaggtaacattgtgaccttgcatcaagaaagtgagcttgttcagctacataaaatcctaggtcataagcaggacaagacattgcatcgctgttgtaattgtttaggtataaagctaatacagtgcatatagggtctgtattgggaaaactataaaacactgatgaaagaaataaaaacacaataaatgaagaagagatattctgtgttcatggaatagaagattcaatattgttaagatgtcagttcttcctaacttgatcttaagattcaacaaaatctcaatctaagtcccagtgtctattttgtagataatcaataaaccaattctaaagtttatgtagaaaggcaaaagacctataatagcaaacatagtcgtactgaagaaggaaaacaaaaagttggagtactacagttaaccaatttcaggaataactgttaagctacagtagtcaagataatgtggtattggagaaatactagacatatagatcaatgaaatatatcagaaaacccagaatagacatatacaaatatagtttactgctctgtaacaaagacacaaagatgatccaatgaagaaagtagtgtcttttcaacactgcaaattagcaaaacatcatacccctctaaacctattagaatgactaatatccaccaaaaaaaaaaaatgaaagtaccagttgctaacatggatgtgacacaaacaggaattttcatttattgctagtggcaatgcaagttggtacagttactttgacatttcatacaaaattaagcatagtcttaagatactatccagcaatcacattcttacctaattgattcaaaatcttatttctgggctgagtgccatgggtcacccctataacctcagcactttgggaggccaagatgggagcgttgcttgagcccagaagtttgagaccagcttgggcaatataatgagacactgactctccagatttttttatttaattatccaagtgtggagctgcacacatatggttccagctacctgggaggctgaggtgggaagatcgcttgcacccgggcagttgaggctgcagtgagccatgatcatgccactgcactctagcctaggccacagagggagactccatatcaagaaaaacaaaaacaaaaacacttatttctgcagaaaagcctgcatacaaatatgtataagcagctttatataaaatcaccaaaaactggaagcaacccaaatgccctttggtaggcaaacgaataaagaaatggtggtatatgcacacagtggaatactattcaataataaaaaggaataaaaagaaatgagctgttgcttgtctcactcataaatgaacaatgaaaacacatggacacagggaggggaacatcacacgctggggcctgtcagagagttgggggcaagggaggggagagcattaggacaaatacctaatgcatgcggggcttaaaacctagatgacgggttgataggtgcagccaaccaccatggtacatgtatacctatgtaacaaacctgcatgttctgcacatgtatcccagaactttaaaaaaaaaaagccttaaaatagcaaaaaaagaaattagctatcactttatacataaacatgcttgagtcttaaatatatattgctcagtgaaaggagtcagtctgaaaacgctaaatattgtatgattcaaataatataactattttttaaaaccccaaaggcgactgggcacagtggctcaggcctgtaatcccagcactttggaaggccgaactgggtggatcatgaggtcaggggttcgagaccagcctggccagcatggtgaaaccctgtctctactaaaaatacaaaaattagccaggtatggtggtgcatccctgtaatcacagctactcaggaggccgaggcagaagaattgcttgaacctgggaggcgggggttgcagtgagccaagattgagctactgcactccagcctaagggacacagcaagacttcatcgaaaaaaaaaaaaaaaaaaaaaaaaaagaaaagcccaaaggcaagtgtattagtctgttcttgcattgctataaagaaacactcaagactgggtaatttataacaaaagaaaggtttaattggctcccagttccacaggctgtactggaagtatagtggcttctgcttttggggaggcctcagaaagtttccaatcatggcagaaggcaaaagggaggcaggtgtcttacatggcaggagcaggagcaggatgggggaagatgctgtacacttttaaacaaccagatctcatgagaactcactatcatgaggacagtatcacagggtatggtgctaaactattcctgagaaaccaccaccatgatccaatcccctcccaccaggtcccacctcctacattggggattaccatttaacatgagatttgggtggggacacagattcaagctatatcaccaagtctgaagaattacatgacattttttaaaaggcaaaactatagagacaatgtatgagttaggattgtacagaaaatttgaaacaatagaatgtgtctatttgtagaaagggattaattatagaaagcagctcatgaaattatgtctgctggtaaatccaaaatctgcagtttagcaggtttgagaacaggagagtcaatggtagttctagttagaaggctggcagcctggagactcaggagagctgatggtgcagtttcagttcaaagggcagcaggctcatgactcatggaggagccagtgttgcaaatgaatttttaagggcaaatgttgcagataaaatctgaaggcagtctgctggagaatttcttttttcctcccggaggctggtctttttgtctattcaggtctccagctgattggataaggcctacccacattatggagggcaaaatgattaagcatatattaaatgttaatatcatccacaaacaacttttaagttgacagaaaaaaaaaataataaccatcccagaagataaagggatcagtggttgcctgaggtttgtggaggagaagaggtttgaataggtgaggcactgagagttttttaagggccatgaaacaatgatactgtaattgtggtgtagtggattgactgatgaccccccaaaaggatgtgtccacatcctaattcctagataatgtgattacattacatggcagaaatgtgaatatcaccttatgtaatatctaatgtgttaaacagatatgtttatatgattaaggactaaggacaggtgtgattaagaattaatgaatagggcctctcatggtggctcacgcctgtaatcccagcactttgggaggccgtggtgggtgggtcacctgaggtagatcaggtgtttgagaccagcctggtcaacatggcgaaaccctgtctctactaaaaatacaaaaattagcttgttgtggtggtgcatgcctgtaatcccagctactggggaagctgacacaggagcattgcttgaacctgggaggcggaggttgcagtgagctgagatgttgccactgaacttcagcctgggtgacagactgagactctgtctcaaggaaaaaaaaaaaaaaacaagttttaatgaagggattatttggaactatctaggtgggctctaaaagactacttcagccaggtagtgaaggtcggcatccacagtgataagtcatgttgttagtatacgctcttgctgtggtatgatgtaaatggcactttacctctctggtttccctccccaaaactcatagactcagtttataatcatgaaaaaaaattcagacaaattccaatggagggacattctgcagaatacctaatgactatttcgtattaaaactgttaaggtcctataaacatgggaagtctggtaaactcacagaacttagaagatgaaggagatatgatgtaattaattttcttggttgggaacctggaacagaaagaggacattaagtaaaaactaagtaaatctaaataagtctgaataaaatgagtttagttagtaataatgtaccaatattggttcattaattttgacaaacataccatgttaatgtaaaatgctagtaagaggaaatgctatatggatatatgggaactttgtactatctttggaaatttcctgtaaatgcataactattctaaaaatttatttttacaagagcctgtgtacatgcaggcctgacctttaaaagaaaaaaaaagtacaaatttcctcctaagttgtgtattagtttcctacaactgtttatcaaagaaccacaaactgggtgaattgaaacaacctaagcttgttctatcaaagttctggagaccagaagctcaaaaatcaatgtgtctgcagtgccatgctctctctgaagtttctagggacaatgctcccttgcctttttcagcctctggtgactcctggctttccttagcatttttgggcttccagatgcatcactccaatctctgctttcatcttctcatgttcatctttcctatgtttctgttttctccttttcagattcttaaaaggatattcatcattgaatttagggcccacccaaatctaatatgatcttaagatccttaattacctctgcaaagagccttattccaaataaagttccattctgaagttccaggtgttgacatctgtttcgggacccactattccacccacttacaccatgccatatccataaagtgttcaaccatctgcatgaactgggcaaaagaagccttcagaaaaataatctacagtacaattgagtatattattagtctgccaagtgttagaattttcttaatgattataataataggtaataattattgaactcttactgtatggtattcactgataagcatgctctacatatattctcttttaattttcatactgcggttatccttcatttgtaggtgataaaaccaaagcactgagtagtgaagaaacttgcctaaagtcatacagctggtaaatttcctcccagtgttaacagcatttattgctattaaaactgctaataaaatgtgtatcaaacatttgcagaaattctgaatccttctatggaacctgaggattctactttaaggtttaaagtcatgagagagagaggtttacattgaaagagttttcagctccttggtaagaagttttatcagtctcttttgctgaggggttcttgtgatagaactcaatagtgctttttcaatttataggatttcaggtaagattccacctccgttatccagctatcttctaatatactcttatcttctctattaaatgtttctctctgaaaatgatttaccttcttattcaggcttcctcctcagtagaataaccccaaactcctccccacccctatacatgcacacatgtgctattttatccatttaacttgtgtcttcccccaaagacttaaaaattccttcttaataatgtaaaaacttataaactctgctacaagcatacgtaacatttctcgaggctattaaaaatatctagatgtcaggtaagtgtatatgatgaagtaagtgattcaaatagaacaattaacagatggcagcaacaattatatattcatattcctggccaacagcatttggtagatataattaccttacaggtgttaactgccctttatggaatgagacatctctgaacactagagaaacatggttaacgatggtcacaaatcagtaaaaattctatattgactcatttttttagacaagaatcagaaagctaaattcagtttttggagtatagtgctaagttcagaaaaagtgaaacttaaacaggagagcaggtgtggtgtaatcttcaagttgattgctgggatggggaaaaaaaaaccccgcacattaaaagacatttaaaattcactcaacatttggaaggtacagagtccaaaaaggcaatcatttagggagaaggaagcagctgttttgacttattcctttgagtttctttaaattaccttagtttcatatgcaaaatagtattaacatgcttttttcaaacaaaacttttctgtgcagataagtttgtacttatgtttctttatagcctttagattattatactagaatgaggataaaatataattttaatgttactgtttataatgtttcaatcatttgaccagaaatatttgaaaacctggatagcctcacacacacacacacaaattacatcattcaagtgttgtcattttacttttattttctcctgtgaacagtaaatatttgtcacttccatttaacatttgtatcacttgcagctatctgtccagggaaatattaaatgactatcagtccctactgggagtgatattgtctgattaaaactaaatttcctcccttctgttctacattggagtcatctctaaatctctgaatttaagctgtactcagcactataatttaaggctaatttattttacctttattttttaagttatgttttcaaagtttttgattttgtagttttacatagtaatagttttacaactattttgtaaagctcttgaagttcagcatgcctcttctcaactcttatttattgctgaataatagttattactcaataaatattttgattgattaataaaaacctatttcaaataactattttctaaaattatttttttctcttccaattctgaaggaaaaaaaggtaatatacagaagtgggttgttatggggaaacatgtttattgtgctatagtcctcttttcccctgtaatgaaaagttaggtttttagtagtagaaatgtcattttagtgaaatatgccataattttactttagcgttatattccctataacaattgaaattaagtacatgttgaaatacttccttaaaaaaatttaaactggagtttaagttttgacttctttgtctaagatattctccaacacacctgatgtttcattttcttctttttcttgtgcagttaagaatattatacttttctgcctttatcatgattaatattcaataagtaaagaaatttttccataagcaatacatacataaaatacaaccataaggaaacacttttaatcttccctggtttctggcttatgagtttggtaattccttagcatttaacctttgtcacaaattgccatgtggcagtgtgtatgctgtctttttgatagatttccagtagtgggattactatattcaaaataaagagcctcaaatagagataaacatttatgtttcatgatactctcgttttagattggaaacattcagaagtttctgaggtgagaattgttaaaagaagaaagctgtcctacatagaatacctttaagaatacaatttttacatattatttgaaacaccaaaattattagtagtaatataatatcaattctaatcatgtctataagaatagatttgcataggaaaaactagaattgacatgcaaaaaattaatattagtcgtgcttgaaagtaggattaagtttaaaattatataatgataacaaaatattatcaaattgaaaagttacagggaaattagttaacaacatttctttcagttaactttttttcagatttcattggattacaatggaatactgaagaatcagacttcttcctgaaacactgagactggaaaaaacatttaaccttatttttaatacaaagagaaggataggaactattttgtgtggttgttgtaggaaccaaagaaaatgacacataaagcacctaaataattgcctggtatatagctattgctgaatacatccaaactttccttaatttttaaaatatgtccatcggttcatttgaaaatagagaatatctagcataaatatttttgaagctattctcctaagcattgcagttactggttttccattatacttaaccttatcatgatatcctggagttaatgtgaaaggagaagtaaccatgattgagaaacctgtatacaacagaagtctttctcttttgagacaaagccaatttggtccttgagtaaatttatttttttagctattattttatcagagacaactgtagcttattcctggaaataactggcaaagtcagcagcactattagaaataaatcctttgagaaaatattttcaaacttctattatataattttgaatttttcattacacctaaagaagtttgtgaaatatgttttagcaagaatgtcaatattcaaaaccttttatattttaggagatgtttgcattcttcattggagagtaaaattgggacttaagtaacaatatctaatacaattcattttgatctttgaaatttaatgtaaagaaacaggaatcaaaggaatgtaaatttaaaaaaaaaaccaaaaaacacatccatggcttgtgttgtttgttatttgtttagttatgtttaagtttttttaacttatgtttttaggtatgtttttattactggagagaatcaagaccctgtaaatatactttactagcttagattccatttaattactagattatatgttatttagccaataggtgaaatttaaatttacgcatgtcacttagtatcttcacctggcttttcagaaacagctgatttatgctattagagcatttaaataatgtttctcactgttcttttcaagactaaatggaagctcacctgagagaaatgcagtaaatgaagtcaactggcagatgttctatgggaaagaaagtgctattgcagtttagacttccagtgttcagaacttccgaaaaagttttttacaagataaacctaaggaaagtgaatgaccaaggattaagaggaaaattttcttctcagattaaaaccatagaataaataggaagcagctgagaaatgtgtggcagatttctcaagtggaaaaaggttaatgttggggttgccctcaggatcaattttaatactggtagcatgaaatctattaatgagtcagaaggcaagctggagatattttgctgatgtcatcattttgtctcataccagtaacaagaatagattaagaacatagctaaaagaaaaaccacatttttaaaaaaattcagaggtcattataaacaccaaactcaaaacagtcctttccaaacatgtggctttcctgtgttcatggttcaaaggaaattgttaagggaaaacttctttagttttattgttaatgtaaaaagtggtgtgtaaaattcagcattcttcctgcttttctgaattctacgtcctgtatttgtcagcagaagtggccatattagagaaaaaatatgtgcatgcatagtttcttccaaaattgggattggatggctaaggcaggtgccagggtatttgtgcaacacagacacgccaccatgtaagtccacggtgacctagctttgttcccattaggtgcaaatcatgctatagatcccttcaccaaaaactctgatggatagaagagcaaatgaagttatttgagtcataggtcactatgactattatgtattggtattattgttgtttgcctatgagcatttcataatcaaagaatctttgcatgatgagtgggtttcttgtgttttccataatgaggacgacttcttgttgagtttgtgcatttattggttcttggatcatgtttatcctgtcacaaaaaaatgaattataaaatacaagcatttttaacataacatggtccaggcacagtggctgaagcctgtaaccccaacactttggccgacgtgggtggattgcctgaggtcaggagttcgagaccagtctggccaacatggtaaaaccccatctctactaaaaattcaaaacttagctgggcatggtggtgggcgcctgtaatcctagctacttgggaggctgaggcaggagaatcacttgaacccagaaggcagaggttgcagtgagctgagatcatgccactgtactccagcctgggcgacagagtaagactccatctcataaatacataaataatatgaatatttatatcctgaaaactaggttgcataaaagaaaagctgtgcaaatcttaattgataaaaatgaattaagctggagactaaaaaatacagaaaactgcagcatttaaatacagcagattataaaatgttatattaggggaacaactatttttgttgccaatggattcaaacttactaatttcagattcttctaaagtttatgtcgtgcgattgtaaatgttatactccttgcggaagcattacctaatcaatttgatttgccccattgttattgaagatatattgcttagcactccaaattacaatctctctaacactaacataggaaaatgcttttcaaactgggttttacagaacttatttcttcctagaggagctttagggggtattgaacgctgtaatccataaatctggaattgacatatccttgttcatcaacatagatttgctattcccattaattagtttattttttatttttattttttattttttatttttttgacagagtcttgttctgtctcccaggctggagtgcagtggtatgatctcggctcactgcaacctccgcctcccgggttcatgccattctcctgcctccgcctcccgagcagctgggactacaggcacccgccaccatgccctgctaattttttgtatttttagtagagacagggtttcaccatattagccaggatggtcttgatctcctgacctcgtgatccacacgcctcggcctcccaaagtgctgggattacaggcgtgagccaccatgcccagcctattagtttatatattaatgggaatattttgaaattaggtttcagtaatgacaattttgtctcttcataaatgattgctcaacacaagatcttttctctacctgcattttacagatgaatgaattgaggcttagaaagattacataccttgccaatgttcacctggttattcgtggatccagattggaatataacaaattccacaactctcctctaatccactgcaccatattgttgattgctgatataggtatagggatgtggatttcctttgcagtcttagaaagaatagattatttttacccaagctttggattcttgtctctttggttgcaccatgtcttatctgccaaatcttatctgtccctctttggttgtgacacatcttattgttgaaaaaattttgtgaagacatctgatttttccagagatatatagttatcaatatattcacatgtatctgtagcacgatgttttcataatccaagaataaatcaaatggcctgatatttcaaataagggtcagattatatctgtactacatttcaaatattaagtatagataaaactaattaattctaaattaaataaagataagaagcatagaaaattcatttctaagaggttgtaggtcctaaatctaaatttagataatactgtgtccctgttaaccttaatccatccctgaccagtaactgacattgtaaataaaaggcagattagaccatcaagtatagaagatataattaggagtatcaagtgtaacagaagtagaagaaatcttgtaaaatgtaacaaatgattgagataagctgtgattttcacatataagcaatagtctgtgagtagttttggggaggaatgttaaggagggctttagtgaggattcagggtgaagtggagagggtgtttacttgtgaatgtataccgctctgtgtgttgattttgcagataaaaaacacattttcaagttagtgactagtatgcattaaatatgggagagtaaaagaaggatgtatttaataggaaattcacttattttccatctgtatctgattatcttaaaataagacttgttcactgtaataccatgtgaacattaacattcaggttttaattataagttataaactaataataaaatgtatatcatatattactttttgaaatcccttttatatctgttattctaagtcatttaaaccttgaaagcttgtaatatagggattagcattcccattttaatgatggaaaaaagcatctataaaactttagtgtgaaatttatctcttcactcccttaattactcttatatggcttttattatataccacttgcttcctaattttatttttatgatcagctttttataataaaatcattactcttgtggctgtatacctgtctatatgtttttgacattctgtacatttttacataagtgtctgtttcagttgtaccaaggagacatgtgtgggaaagtggagaaagggtgagcacttccaattttatatgtggctatagaaggtacatttcctagaacacttgctacagaagtgggacattgcttctgaatgtcctacatgtatgagccagaggatcctaggggacatatgtgtttgacttagaaaccaagagtaaatgactgtgtccagtcaggtatgctgagctgttcaggctggctggagacctgtatgattttggggtatggtgctgggtgcagtccagtagctggaagttggccagaatgccaagtgcttgatatatgtcctgggatgattggcattaccttgaatgtgacagagagtagaggagtgacataatgggattgcattttaggaatatcaccctgggggactgtgttttggtttaattttttttttaatcgcagaataagacacatgtataaacaaaagaatggctgaagaaaaacaaagtctgtgatacttacatatatagcacaagttgacataaatgccacttatacctgcctttctttttgctcctggcatgcctttatttcagtggcccctctgggtctgctctgtctctgggtctttactctgagctgtatacctgtaatatgttttgctctgtgtccccacccaaatctcatcttgaatcataatccacataagttgaggcagggacctggtgggaggtgattagttcttgggggtcgtttcctccaggctgttcttgtgatagtgagttcttgctagagctttttttttttttttttgagactgagtcttactctgtcacccaggctggagtgcagtggcgcgaccttggctcattgcaacctccacctcctccctggttcaagcaattctcttgcctcattcttccaagtagctgggattacaagtgcatgccaacatgtttggctaattgttttgtatttttactagatacaggatttcaccatgttggctaggctggttttgaactcctgaccttaggtgatccgcccacctccgcctctgaaagtgctgagattacaggcatgagccaccacgcctggccaagctgatgcttttaaagtgtggcacttccccgctcacttgctctctctctcctgccgtcatgtaatacatgccttgcctcctcttcaccttctgccataattgtaagtttcctgaggcattcccacccatgcagcactgtgagtcagttaaaccttttttcttcataaactacctagtctaaggtagttctttacagctgtgtgaaaaagcactaatacaatctggaatacaccccacaaacctctaagtaatcaactcctgcctcttagccttcaaaatgcaactcaaatggtctttcttcaaggaagccttacttgatgccttattatcaatcaaggctttcttgttatatgttgtcatagttctttacagttttcttttataacattaatcacagttttactcaaacactgttggataccataaagatacattctgtaattaaggatagtatatatatgtgtgtgcacttatgtatacatgtgtccgtgtgtgtatactttgtatgtatttagaggactgtgacttcttccttgtgaggtgttttttaagtacacagaagcatttgtttactgggatttgaaaatgatcttgccaaggcaggagaattggtgtttatatttacaactgtctttcaatatacacaaggaattggttctgggacccccatggatcacaaaatctgcagatgctcaagtcccttacacaaaatggtgtaatattttcatgtaacctgagcatatcctcctatatactttaaattttctccacattatttataatacttataaaatgtaaatggtatgtaaatagttgttatactgtatttttatttgtattttttaatttttttccaaatattttcaacccatggttggttgaatctgtagatgcagaacctgcaggtattgagaactgactatatatatgttattttatatatataatttcttatatatatttatgtaatttataatacatgcttatattagaaattatgtatgtgcacaaagcaacaactaactgttaacactggtataattctttcaagtttttttcttctgtctgtgtacatatgtatattctatctgtatacagttacttggctcaataccatagatacattttgtgtctgtctttgtataactaatatactgagaattttctggtgtaattagaaacaaagggaaggctgatagaactggaggcgaagagattagttaggaggctatgtcattcctcttgatgaggtctcagaatcgtgaggatggataatttcagagtaacaaatggcaagatttggagttttatttgatgtaagtgtatggaagagaggaacaactatcatatgcaggatgactctcaggtttgagtaagtgagtagatgactgtagaaggaagaatcctttggaaaaagagataggaaagatgaattcagttaccgacatgagtttgagttgcctgtaagaaatcaaactgcatttacccagttaaccaggctattctaattcaccaacaaagtgaaagcaaaagaatatggcctctgaactctatgtgctaaactatatttagcttccatgttcggaaagcttagtgaattattaagggggattatgactcctcttcccctagagatattttgtaagtacacacaagcatttgtctgttgtgttttgaaaatgaacttgccaaggcagggcaattgccagcccagacaacctgtcaagagctcttccagagctctgaaactgtgatacacttagatttatgtttcctctgtcacatgcttttattgtaccacagttttcctaagtgttttccctttgctgagcaaataagaattcattgtaatttactaaattgtgttctctccatcctaaaatcaaatgctgagatctcatattaacataaaaagtactgatgattcaataccttatttttctttttaatgtctttccatccaagaaagttataatattcacttaaagaaactgtatcatatgtactagccatgcatgcagtttttacatatttttacctatattttccattctctttactaaatttctctgcagtgtgattcaaactaagtactgaagtaaatgctagtgtcattaaaataaaatacacattaagaatgctatagtaaaaagtttggatactaagtaaaagtcagtttctaaaattaacatatttgttgagcaaatctgtaactagccctcacaaccagctctctgtcttatcaagatttagtttgctattcatgctcagacatggatagtaagagtggtaataacattagaagaataaattcatgaaagctgtaaaacctttttcagcaccctcccctccatcttcacaggtaaaattaagcattcattcaatcataagtcattcacagatacacctgttatgtgttagatatcatgttaggttctggaaatataaaaatagaaaagaaatgagaagtgccctcactccagtagtagagacaagcatataaactgatcatctaaaaatgcgagatccatacccatatcacaaagcattataaaggcatctaactgagcatggagaagatatggaatcaaataaagaatcctggagagcacctgagctgagtgatatcaaaggataattaagaagagttagccagatggggtggttgggtgagagagagtgactctcatggagggaggtgtgttcctataacttagaaaacccagttataggtacattttaagtaagcataaaactacatttccagataaaaatgatatttgtttcatatcagaaaaatgatgtaaaatagcaatttttactgtcatttgtatgcagatttaagaggaatattctgagatacagtttaagttctacagctagtctgttttttctcttattctttatttcctctaacttagtaaatacttccataattacaggtcaacaagaatgatctctagcagatatttagttactggcagttctggatgtttggatctagggttaaaccagaaatagtgaagagatgttttactggaaagtacttttggcaaactgtcagcgtctaagttggcaagcatgtctgactgaaaagctagaaggttaaatgtattaacttaggatataatgataaatagatttttacatggtctttggttgcattcaggagttgaaatttgttttcatatttggttatagcagtggatgcatttttaaatatgcctaccgataggacatcacttgctttctcaaaaatatagaaaactattgtgatgttgttgtagattagagttaagcttgcaacaattgtgtcatttgaactgccgatcctcaccatcagacgtggtgatatgtaggtcctgacagtcagtaaattgaaaagattgctgaattggactatttgggcacaccacctgaaataattcaaatggtcttaaatagcatttgtgtcagcaaggaatgtgttaatctcaaccttcattttgaaaacccatgtgagcttgtttccccttgagagtcaacatacttcagtttggcaaggcagtcttgcattcattcctcattttttcactcaatacactgaaaatatatggttatattcactgtttttgatcattttcttcaacactgaatcaagctcagacagtactgtgcttgactcttggctcttctcaaatgaatgaaatatctatattgacattttttttttttacttctatcttcaaagtgccaactttcccttctgcataaatatctgtgctcctctagtgttgaatccacctgcatatgtagtcctagctctatggggtgactggtaccaaaagatatggagccttttgccctgaagctgattctgcacatctatcaagagcatatcctctgcacattaatggcttgttcagctgttaaatgaaacgtcggctactacttccaaaagacagggattgataacttttccacattgtatggctcctctaccttgacattagacaatgtctagcattgttcattgatgtagacattttgtaaatagggtgtcctgattctttgagtgcataatatttatcattaattttatcaggggccaactcaaaagtagtgttgataggttgggcatggtggctcacacctgtaatcctagcatttttggagaccaagatgggaggactgctcgaggccagaagtttaagaccagtctggacaagatagtgagaccctgtctccacaaaaataaaaataagtagccccaaaaaataaaacaaatcaacatggtggtgcatacctgtagtattagacactcaggagactgaggcaggaggattgcttaagcccagtatttccagattaaggtgagctatgattgagccattgatttccagctagggcaacagagcaagagcctgtctctcctcctccccccccaaaaaagtagtgtgtatacacttgctttacttatgagagaatcaattgaagtctctgttttttcatcctttctcattttgggggaataaaattatcaattatatcatggaaaatgttttgttcttgttctataaacagttgtttgctttactacagaggttactgggcttgttttgaaaatggtgaaaaagtcaatagatttagcccactatttcaaaatattttattaccaacagttcactgagctctaggtatgaatggatcaccagtataagaaaatccaagttttcaagtatttaagttgtgcttcctttcttgtctttctatcactgcttgttctagcacaaagagattcacattatattttgacactggactctgtcgttatggtaaggagctagcttatgttcattaccatttttagtcttgatgaaccaattctgagacattgatacctttttaaattgttgtcatatagcaagaaaagagtattaagtttaaaaacacatttaacatatgtaaataatgaatacaacttaaaaataaggtagataagacaactgtatcagaacaatccttgtgcaggtgtgagccattaataatgtaacaattattaataatgtatgtgggttacattgaaaatcataattaattttacatttcaaacttttgaaacttgtaaaagggcaagtatgacaagcataggactcatttagaaggctgatgaggctgttcatttgcattttgctactctaatattgttttacaagctattgttttaacagtataaattaaatataatcattgacacatggtagttttttttaaatgttcttggaaattatcattctgttctgtgtattatgagctaaatgtttgtgttcccccaaaatccatatgttgaagccctctactccattgagatggcatttggaggtcagagtttggggaaacaattaggtttaaatgtagtataaggatgcaacacctgttatattagtgtccttatcagagaaagagatgtgaactagctcattctctgtcgtgtaaggacaaaaatagaaggcagctatctgtaatctggaagaggtacctcatcagaacctgcccttgctatcaccccaatctcagattcccagcctccagaactgtgagaaatatatttctgctctggaaaccacccagactatgatagtttatggaagcccaagcagaccacaacactgggaaattctttgtatatcattacttacaatttccagatttttaaatgtaaactctgtgcagtgttaaagagaatattgtttttgcatctgtcaaaactgaatttgaattctggccaggtgaagacaggttatggcaaggtacctcaccagaggtactatcaatacattattcaatcccctatcagtaagttagtcaatttcctcttttgtaaaatttagcaagggaaatctgccatttagagttcttatgggtactaaatgaaataatatatataaagctttttccatggcacatagtacgtaccttgttgcctctactctctttttctgcactaggtacaatcaacagtcaaattttttcttcttttgttattttattgcatttttattgataatgtcttagctattttttattcactaaaatgactgtattagcttgttattttagcgtcatatgagggaaacactaaacttagtacgatttttaaaaagtcaatacaaacactaaaacaatgttggcacttaaagaatgtgctttaggaataactaattctgagtgaaatttgtgtgtgtgtgtgtgtgtgtgtgtgtgtgtgtgtgtgtgtgtgtgtgttttgctatttagggatttggtttgtttttggcatggcctgggacataatcaaatggttgagagatcactttctgatccatgtaaaattaaaagcaaattgcaatgatgagatggttgacaaatgaaaagaaatatgattatgtcaaggagaaaatagaggcctctcgtgacacagtccttggcatgtgcccatgtaggggactgctgtcttgctcatcaggaggtgccatctcaattatacctctccatgtgaatccttgtccaatgatgcagatccactctgagagagtcaagttttctattagagacacttgaaaatcttcatctctcaaattgttacaagtattatgatttaatacagatatttttgttacatttttaaaagaagtttgatgacatagtatgtatgtaacttaaggcaaattgatatacaaacactttttctttattttaactttgatgaaataactgatcattcttttacttaaaattatatgttttttactcaaatacaaataattttaaagaccttgaagaaatacaatttatttctccatcactttttacattatacagctttgggctagaggaattaatacattattctgctttaggggaagtgtttcaaaatatttttaaaatatgtattcctggtatacattatgccttggtgcatcagagaattgaattatagttttccttagaaaatgtatacaaacaatgtgttctcaaagcatgtaaaagaagaaaaggaaaaggtgaaactgtcatactgtaattgctgagtaccacattttcatgattttcttaaggccttccatttatgctataaatttcttctaaaaacaaacaatttatatacttatatattatataatactatatgagataaacatgtactagcaagttatgagtagcatcagttgttgaagtataattacatggattgcttaattttggttatttatcagaatgtattagtaaatgtctagctatgttgtcttgtatttaagacaaatcattctaatttcagaacaatccaaaaattagccaagtggatatttctttaaacccagttttgaagaatttatagtaaagtacctctgttaggccctcagatcatttatacttaccaaattcttttttatttacctttacaaaaaaatactaaaatattccaagaaagaattaaagtatattggaatgttataaatagctacagtttgatcatgacatttgggtgctagaaatgtgcttgagctctcatttatattgaagataaataaacgactaaactttttaaacaattctccccatagttttacattcaaaagaattattgaaatattcagtactaatgttaaatgatatattgagaatttcacttgtagataaaaagacagtttgcattcatgtatgaaaatgagtgggtaggcccaagggatttggtttagaggaaaagctttgtgtttagcagcattgtctattcttttgtgtagttttctatatgtcacacttctattagattttagtgcttttttttttcaagttagttgtttttcctagcgctttacacacacattttttcaagcacctgaaaatgggcaaagtaatccagaaatcatgcttttttcccaaaattatttagcttgacattttgaaaatcaaaactcaatgcttttattttctacagagggagtagaagatggataaacagccaaacacttaattgggtttggggaaagaaaaagaaacaacaacaaaactaaacgattcttcccaaaactctcaagggttttatttttataagtgataatgctagtggaccactaatatacaactacaataaagttaataactacattttattcataaagtttgccaggtaattttctatgtactttctattatcgcatcttattttatccttaattcaactctataaggtagatactagttttttgtttttctcatttcatagatttgggaaggatgtctgtggatgttaagtaacttgcactaagttacctgtagtctgattccacagcctgttcactaaggcatttcatatacatgtatgaccttttcagcaatggagaaaaacacatagaagccaggaaatactcttgtgaaacttgttctaggctattatcataatcggagtggtaaaattaaaagcagtgtacaatgagacttgatctccagaatcatagaacataagtggcattaaactcaaggtaaatggtaatgacgcaggctgtaaaaactaactccttaggtctccatgtgaatgaaaaagatgtttaatgtgcattaaatggcagcatctgttctagagtgtaacctgaaaaaaatcagttgtttatgaattaaacttagttagtgcagggcatctgatttttaaatgggaatatcaagtaacctaagacaccaaagatctgttcttcctatgctatgaaagtaacatccattgatttcagtaattttctttctgtcttcatgagttttattttgatattttatgctcaaagcctttagatttcgtaacacctcctttagggtaaaattgtttaaagttaatatattcatcgctttcttactctacacttagcactgaataagaaataagtgaggtaaggccgggtgcggtggctcacgcctgtaatcccagcactttgggaggctgaggtgggcggatcacaaggtcaggagatcaagaccatcctggctaacacggtgaaaccccgtctctactaaaaatacaaaaaaatagcagggcgtggtggcgggcgcctgtagtcccagctactccggaggctgaggcagcagaatggcgcgaacccgggaggcggagcttgcggtgagccgagatcgtgccactgcactccagcctgggcgacagagcaagactccgtctcaaaagaaaaaaaaaaaaaaaagaaataagtgaggtaatacgtttcttgccctagagaaacttgctctctagttgagaaaacaagagaagtatttgaaagatcaagaaacaataaaaggcaattaaaaatgaatatcattaaactagtttgatattcatgatagataaaatgttttaagtactcttcagattttcatctttatgtttacactttcttctgtccaagacttttcacctttggaacatttcaaagtttcacaatgaccttttcctctcctctcagttgatttcaccaagtaatttgacatttttgttattctaattaatatttttactttgcttctttagcattaaaccatgttaagggtttttctagagcattaccctggtcagttgtttaaatctcattttataaagacattcagacataagctttcgttgatggcttttctgttaccgaagagtaaccttcaatcagtaaaaatgtgtaggtcacttatatgccaggaacttactgactaaagaatacacaatgatccattctatttattcagtcagttatttatcagctcaaatatgtattgagcaatgattacgtaccaagtattttagtatggaaagacagaatataggccgggcgtggtggcttatgcctataatcccagaactttgggaggccgaggcaggcggatcacgaggttaggagttcgagaccgtcctggctaacacagtgaaaccctgtctctactaaaaatacaaaaagcccggcgtagtggccagtgcctgtagtcccagcaactcgggaggctgaggcaggagaatggcgagaacctgggaggtggagcttgcagtgagccgagatcgcaccactgtactccagcctgggtgacagagtgagactccgtctcaaaaaaagaaaaggaaagacagaatgtaatgaagttaagtaaaatataaatgattttagatggcaataattgcttgggagaaaaatgaagaagtaaatggatatcaaggaaagcttcattaagaaggtgacatttgaataaagccttacaggaggcgaggaaaggagacacatgaatatctggtagaataacattctaggcagagagaaaagcaggtacaaaggccctgcttgggacaagaagcgtagctggcatgtttgaacggagcaagcaaggctgagtagtaggtgctgaggtcagtgcaggtgagatggtgtggggagacaccatctgcaggacctggccttccactcctactgtgattcagatgggaagtcactgggggctttttcaggatccctgtaacaaactgtgggaagacaggtcaaagaggaagcagggttcatttgatatggtatggagagtttcactgattgcagccccaggtgataatggctaaaatgaaataaatagcattggtggaagtcatggtcaagtggacagattctaatctaaacatcatgcagggggaaaaaaagaattgtctgatgaaaaggatgtgatgtgtcagattgaagtgggagagttctgtgacccctatcgcaggatgttcaacaggggtgtggctcacctgttcagctgaaaccccttacaggagggggaacatgcagatgggcaggtgcaggaaccagggtgagcacttttgggctctagccccacagtagcaactaggggtgggtgcctgtgactcctgaagccccagtgggtatgttacagtgctccttatctctgccatctgcagatggcttaagtgttaatcagctcagtgccttcttggtacccgggtctttgtctggtgtccaggaagaatcaggtcacacaaagacttgaaggatggtgaatgagggggttttattgagtggtagtggctctcagcgggatgtatggggacccggaaagggggtggagtgggaagatgatcttcccctggagtttggctgtttcacggctgatctcctctccagccttccccagccaagctcctcaacatttagacactccttgtcttctctccttctctgccgctccactcttctgttcctctgttcttctgctcatctgctcaaggaacctggggtttggtgttaatatgggaagaggatagggcagcatggcaggccaaaaggcaacatttgggtgcaaaaacaggaatacctgtttccatttagggccacgtgtttccaggcttgagggtggggcctttgctggggaactgccctcttctacccagcatttccctgcctcttgtctatatcaagatgaaggaaggcctttggatgattctcaggtttttgaactgaactggagtgactttactgagataggaaagcttggccagggaacatgctatggaatcacattagctcggatttggagattttgtttgagatactcattagaaaattaagttgaaatatttggtaggtaattgaatacatgagtctggagttcaggaagaggtttagctggagattaacattcaaaagtattttccttccccatgcacactttcttccacctgggatgaatggatatagtagtagataaatacggcaatttgaatagaagttctttcctgtctaaaatggcagggaagattttctgcaaccctattatttctgaaggtccttcataccccctcactttacaatgaaagcatgtagtcatgttttggaaaagaccacatttgtaactcctgtggggacacgccctatttttcctgtcttaagacttttaaaattttatttacctcttttttccaacagtgctttgactttattacattaaaataaatttacctgcctgtgggccttcacttttatcacacagtgagttatataagaaaaggagtcatgtcttattcacctttgaattctaagcaagtgatctggcctctgtaatttcttgctaattatttgataaagatacttgttcttgacatttaaatggctactaggcaactgatcttggagtttattctatatttttaaaatctgctatatattgcaaacatattagttgcttgttttaacatttattgagctccatttcttcaagactcagtttacataaaccatttatctctagagagggcatacgtgttaatataggaggcccaaacacccaaatgaatggaagacatgatgcattaaatgctttaataaaggtacagattaaaacattatttatcacattgttactttgtcagacttcctgaccaagctgtcactgaaagaatagtatattccaactctacattgaagtgtttcaatagggagatcaatagtggggaatgtattctgattagatggaatgaaatagataatggtacatatgttggacagtgctacattagttttggtagcagatgaatacattggcaggagtatagggcattgggagaatacatgagataaagtggcactatgtgttagaagatctttgggctctagggcaaaggcattttactgtattttgttcatcctaggaaatctctaacaattatttggatgtgaacaggttatgtaattagaactgtactttcaaaggtctagatgaaaaatacactatgaatattaatggtagcaagatttcctaatagttcaggtgagagaaagttaggacctgaatgaaagaaaaagacatagaattgctagctattatattaaatgatgtattaagtagatgtggtaacagatgaggtactatgtgggaaacagaagagccaatgatgtctttaaggttttagtctggaaactaacatccttaatagaagcaggaaggttagaatgaggtgcttgtggaaaatgatgatgaatcttgttttaaacattatattagcatccagatggaaatccacaggcagtttgaaattcagagccagaattcaagagctaggttggaactggtaatttagatttggatgtagaaaaaaatgtgaatactaagttagtatattcacagaacaaacatgaaataatctcccagttcttttacacttttacacacttctttgtttactattcttctgtgaatatttatacagattagaaccttctacataatacttcaaaatgtagccctaccaggacatatttatggaaacaaaggaaaccagtcttctaggttgtcgtttctatgtgttgttaacattttgtgatttcctgtggaatggaaccctttgaaaatagtagtagattttaatagaaaatatcttaattaaataccttgcataaagtatttgagacataaattacttttttacttatacaatttaaggagattttattttcttctaaggccactataaaacacactggaacatttgactaaccctgtagactggctcgagccagttcatgctctaacacttacttttgaataccttttcaaaagtaaagaaatgaattatttaggtatatatcaagaggaatttccttttatttatttatattctatgtgtcttcatatataggagttattcagctctgagatataatcaattagaatattgaaagagatttcataggaaacaaagatcaactaatgttcaaaaaattacaaacatgaaaagagaaaggtgagattttgacactggaaaatattaggctcccctaatgtttcagtgtatggatgtttattaaaatttttctggacaacctcagtccttaaaattactggacataaaatatatagcagcactatgaaagcttttaaagtgagaatattcataaggctgagtttgctatgattttaatagtccctaagttatttcctaactttcaaatgaccatatttattctagtaatttaaaaaaatttgtcttcattccattatctcaaaaaagatcatgactcttccattttaatatgttctcagattttccaggtagaagtgaaggagttcattattcttatctttgtcaatttcctaatttacaaatgagctgaagcaattaatccttgcaagtcgcctgtattaattatagtctaaggcaggtttatttgcagttttgtaattctttttgtcacattttcactgtgtttactatctcagcttgatgcttgttgacatgctgattcatgttttggtgcactagataggttttattcatctagaggaatgagtataaagaggtcacaccttataatcacactagcatttctagtatgtgcaggccatatatctccttttaatttaatctctgaaaaatgtacagggatttctgcagctaagctgtacaaatcaataaaatttataatcaaggctgtctaatctctaaacctaatataagacttcacaactattgattatatgtgaaggatctgcaagctgttaatcatgcatgaaggcataaaataaatggtggcttcagaaaaggaaatggacaaataatcatcaaccctgcagtccttatctgtctctctattccctgaagcaagcatgttaccagacacttacattttataaaatcaaatgaggtgttaaagtgtgtatcaatagtcatgctgacttttgtatattatatcctgtttctattataatgtagaattgttctctttatcttccagatgtgtgatgaaaagcaaattagtctctctaataagtttctagaaggaaagaaggacctaagttgatgtgttaaaatcataatctttctaaggaacaaaatgagaagaacatacttggaatatcattataatgtaattgtaatgatttatttgggggaggggagaagagctccatgtcacgagatagtctcacttaaaactgggccctcttagcattttattaactagtatacttcatgatgattttactagactgaattgactgaccaattcaaggggagatataaaatatttacaagggagttatgtagttgagaaaaacatgtactatttatgcacctaagcagtattagagggatttggataaaaaagaaaaaatatatatatatatatataaatgtattattttctgtcctattcagtcaagagtaaagaaattccaactaacagattctcttatatatacctacaaaatcatattgacataaaaaagttaaatttaatcaatgttatattgcagtgctggaggggtaagttactggtaacctactacagtttgtaataaagtattgatatgtcttattatttatagaattattattccaatatttagtttattattctctgtgggagtgtagtgaagaaattaacccctcctcaaagagcatacagcaagcgaagacaaaaatatatccattaaaagtcgttttaaggcatataccatactaccgtggtatctgggacatttaagcacttaataagtgttttctattattaaaaacaggatgctatttaagttcagcacaacagattagtatagaaatgcaattcttaaattactgtactattttagtgtagatatcactgatagaatcttcacataaatattaaggtaatttaccgaatgaagatattagaaataatgcctgtttcaaaatgctgagtaacaactaaccacaaactctcatcagtggcacagagcaggcacgtattaattatacttgtgggatggttgactagtagcctctgatgatcttggctgacttacatatccactgatggactggctataggttggcttctgctggtacgactcgggtaacttggctctgttccacatgtatctcatattctagaagaggtatgagcaagcaggagaacagaggactttttgagatataggctgacaactagcacacccacacttttgccttattctgctgaccaaaacaagtcacacagcaaggccaaaatcaaagcatggggaagcagaccccatttggtgtgagcagttgcaaagtcacatggcaaacagtgtgacaacaagaagaaatgaataattggaattatttcaactgccacagagaactgggtttttaggtttcattttcattagcttttaagcttgaaacatattgaaactacctgctttattgttcagaaaataaaaatttccaaccatatactatggatcaaccactgtacttggcatgcaaaatattacctcatttttcagaacaacataagaggtaggtaatttatcttcttttagggataaaggaggcattgaaaatcccccttagaattttgtctttgctatgtacagctcctctaaagtcaccttactttttacactgtatattatgaagcagtgttttccatattacatttttttagggttgtacacaaatcactctacctttttgtgtctatgatttatactgttgctaaaaaattttatgaaaaataaagcttgatcctacagaagtagattattctcttcttattttcttctataaattaagaaaatatatttttccaagtatagacagttacctatttttaagttttatttaaataacatgtgaatgtgatgtgcaatatcagagatgaatcgaagtggattcattgattgtagttacatatttttcaacagtctaataacattaccaaaaaatgttaagtgaaagacattaaagggtctccaaattttcagtcaccgtcattttgggaattaggtctgatgataagacatttagtgggctttatctatctattggtaaaagaattatctttgcctttttttccatgtcacttgggtagtactgtcctttaaaatcaaacaatttccttggcattaatgcagagaggatccaagtgttaattttattaaaattatctgataaacttcagtaagagtgttgagagcagtggtgatgacttgttttgtttttaattgatgatgtgcttagtgtggttctgatggcactgggtaaatattactgtgattctgcaggagagctgagtgagccatccaccctctgtcactttatatccctcgagtccaagcatgtcatttcagcaacacagccagaaagcctaaagagctgacagttggcttgtgattattcctggacctgaggctccctcacgttacagtactaatcaagtcatctcaccgacttatcattaactcaatttgacccatgggagcagagatgaaatctttttggcaagactaatgatgctgtaacattgaaaagaagtgaaatgtaaaaccttgattatcctcaaccctttccatgaggaaaagaataaaaattacaaagcacctaaaggtaagagtaaaagacaatgtctttcaaagaccttaagttttccttccccaaggtgcagcactgttttctttgcttttatttttatttttttatttcacctttgtccagaaatttcatctcaattcttttttatttacactaacaaatattttctctggcagtcagaaaattcacttttcttgtatttgttttgataaatggaatgaaagttctgttttgcagtcagcttctaagatttctgatgaaaaggcagccaggagcacgaagctcctgtcatgcttcagcgttcttagtttgtgtacatctttgacaagaactttcttttttttatttttccttggcacgagctttgggacatcttctatttttctctgactgacagctgcataataagttttatcattaaaaactgattctagggaaatatgatccctgccttccattctcttatagatgctaaagcttttgttttcacaactctttcagaataactagaaattatcgctacaaaaagacagggatattgacctgtcatgtcctgagttgtttagcaagtgccaaaaacaaaattaaattcccttttatctgttatctagaaccacgtgttaaatcatcttgctcttgagaggtgactcaaagtcaacaggttctttttgttcatgttgtctttacttttattaacctttagagaattattaagtacttcttcattttagcctatcaagttgggttaaacatttaacacataagttattacaggcataaataccatacttgatctatttagaatttaagtgggggcagtgatatgttacttctttatttacctgctaattatgtaatactgaagatttaatatataaattttctgacatttctttatatttcatcctgatttcatgtagcctttctcactgtaacaattaagaattaggtgcacaataaaaggcaaaaaagaagtaggaaaagttagtaaaacttgctgatcaacatttgacagggaagataaagaaaaccaggtaatgttaacagttcctattgaatatatgtatttttaatttaacagttaactgttttccttggacttactggaaatgaaataatggaagagagctttatgcctttgtttgtagataagagcgtataataaaataagtcaagattcatcagctaaagagtagaatggaagagcactggattttacttctggttccagtccttttaccagcttcttaatgttctatctgcactccccctagcccctgactttgttcttcaagtatatgaaaacacacaggaccttcagccttcttaattcctctgcttagtcctatgtcatagctttttcccagtctgaactccctgattgatggggtgtccaagggaaataaacagtcatgtcatgggttcttagtttctgtttctggttgggccaatgaaccccttcctcatccctcttttccacttatcactagaaacagaaactaaaaaccatggcttcaggctgctaaaagcctaaagcaaaacaacagaacaacaacaaaatggggtaggttggacaagcttgagtacactaaacacaaatttcaaaaaagaaaagtagaatgacctgagaaagtgacatcatggtgtttctaaagttataagttgacaatttataaatgtataaatgtatgggatacaaagtgtgttataatttatgaatacaacagggaatagtgaagtgaagctacttatccatcacctcaaacacttaatattttgtgttttgagatctggtttctggtactgacctctgcttttgacttagtgggtctttttagaaaagtcagctttctttcattcaattctttttttttttatctgaaaaatggggcagacactagattttatgcaattctctttggcctctcttgtgaatgaatttgtaacatatgtgcttaacaccaccttcccttcaaactcacctgccccctgtcatgctcactaacacatgctcatctctgtttctgttccgtttccctctttctccctctctctcagagcatcctcttctctccatttctcttttgccctctcctttttcttcttctctcttttctcttaccctatccttatctattaccttctctctttttctttctcttatctctgaaaggatgggagtaccccaactcctgacttaggtagactgatgcctccacttagacctctttctcttcttaatgctctccaagttatctaaaacacagaaatcagttcaagtattgctcgtatgccttgcttcccagctagggacattgtcaaattgatctttgcctccttagtttctagtatactttttggccaacagaaagcaataaataagcagtaagaaattattggatcattttaccccccaatctgtgtctcttcttgaactttctctgttcatttaagagcaccttaattttctttgtcatttggtattaacacattagctatattgtatccattcacataactcaaatccaagtaaccaccaagtttttcagttttccttccacatcagtagcccctatcctgcgtgttcctgctgtccccctccttacttagccctaatctctctgctaacacatcacattcttttgatttctctacattcaatgtctccacaattgacacagcctccaaattaatcttattaatgttattttactatgttaacttcctgctcagaaaccctcaatgacttctcatggcctatcaggtaagttcagcctcttaccatgacatctaaagtttgcctcatcttttcccaaccaacctttcctgtattatctcctatatgatacttgtacagcaaccaagtgggattgcaaattttctccaactgtgttctacgtttttattcaactcgtttcttccattttttgtattatttatctaaatgaggtctaaagatcttgcttctatccattgagacctaacacaaatgtctactccatttgaaaggtggaagttatttctccctcttgaattcctatagcatttttttctacttatataccacttgtaaatatattgtttattttttttcttagcttaacatctttgataaacaaatggaagctccttgaggtctaagattatgctttattcactttagtaccttctggaatacttaggatagtacactgtatatagtaataaaatttctttatgtttcattatagatggatgacttgatctaaacattgaaatataaccactcattgcatgaagatcactcgattactgtgtttcttttttccttttttgttttttgttttgttttgtttttttgttttttcgtttttttttttttttttttttttttttgagagagagtctcttgctctgtcacccaggctggagtgcagtggtgcgatctcggctcactgcaaactctgcctccagggttcaagtgattcttctgccccagcctccccagtaaccaggactacaggcatccaccactacacctggctaattttttgtatttttagtagagatggggtttcaccatgttgctcatgctggtctcgagctcctgagctcaggccatctgcccaccatggcctcccaaactgctaggattatgggggtgagccaccatgcccagcatcactttgtttccttccaagtttctgataaaatttttgactacagccttttccaattctttctttttactagaaatgcaaaaaacaacaaaaaaagaaatgttatataaaattacaatatatggaatacccaataaagatttgaaaaaagaaaatcggaaattgaggaggagcaagaacatatatcatattccaaaacgattgacagataatgaattcatgaatgtgttctccattgtttcaccaccattatggttttttatttgttataaatacgatttactatcatacctctgagtcactgaccctgtaggttatatcttgaagttatttaatacttatagtagctcttatggccagctcataaatatcagtggtttccaaacaatatctttttgctttcggttattctatggcaattcaagtaattattttgattttaaatgttaaatttttatttatgtatttatacctcagaaatacaatgcagttgttggttaggtatgagaaataatggattaaggtcaataatttaggcaactttattgttggaatctttgagaaaaatttctttgaatggattttatagtagtagaaccatctcaaatcactgctgtttataaatattctaatataaaaatgcatgtgcatatagttatcagcccatgtctaagtgaatagtattcagagaagtttgtatgctatagcacctttcacatgtatgtgtatatacacacatatagatgtacatgtatgtactgcatatgtgtatatgtatatgtgtgtatctatacacacaaccctgagaagttcccacctcagtaaaaactgaaaaaatttaaggtgcatgccaattaagaaaaaaatacagttatacagtaactccctctgagttattaattccacgcagctcaaaacaatcaagttttgatttttagtctgtgtgtgtgtgtttactttggttgttcatatgtttctgagtactatcctaaagtgagtgcaaaattatgtctaagtcactattttatcaacatcagggccctttaaagcatacattcaaactgtggaaaaaaatgtcaatttcaaataacatattgactttgtcaattcttagaaagctatttctttccacaactctttgtttttccatatcagttaataaagtattggtcactgaaattatgattgtgctttatatacattgtgtaggactaataaagctactctatcccaattttaaatgagtttttaatacaatgagtgccaaagtaagcagcatttaaagacaccaaaacaaaattatcacttaaagtaaatcctatccattttctgcataacagataataaataaatcatttgcccactcttagatatgtaagaattgaggatgcagagctactctgtcttctttacagtgtgtaagatgtctaggtatgctttcaaaatagtgttaaaatgcagagtaagtgcggactaaatagacaaaatgaaaagaactggcgtgagagagtgatgacttagaaatagagaaatttatacaaggggaaaatgtcagatttaaaatgaggggtgtgttaaaacaagtgtataagtgctagacctaaaaaaaataaaaaattaaagaattagcgggttaaatatttgtggtgtttctctcattgctgtataggcattgtttgctcatatactctaggtattttcatgggaaatcttactttctcattctgtataattttagaacaagatatggctgaatcttgccatggctaccaaacagtatccagttgctacctaggaggcagcaaaatcacagtttatctgggaatttttaggatgatcctagttctcattgcctggttagctggtgggcagtcatagcaaagactgtgttttcggtctaactggactaaattgaaagtatcatcactttactcttgtgtctggtggggaaaatcttagcatagagctaaacatataaaacgatttttaaaataattagaaagcctcgtctttcttccaacctgtggacttcaggtaacgtctgaaatgaaagtggtgaagttgggagtctggatgctgtgaatagtcataagactggcaaataacatttaaaacctaagcattagattctaccgaagataaatttgcacatatgtagatttttgtaatctaagattttaaattaaatggccaccagagttcatttcagattgcacattaaatatattgaactagaatcccagtttgggcttgccatctgtttagcatgctgattgtttttacagaactgtgattttaatctcaaaaacaaaaatttatgaaagcccccaagtcagactttttgtattattttccctactgatttccatttagcaagaatttgactatctttaatgagttaagagaggcatcggaaatcccttgacttttttctttttatcaaatcaatgaattaaagtttttgttgtgtgttagtttttttactctgtagatgttgccatggccatgagtttcatagagtagttacgttgattaagttagatgattcaagttagtcttgaatgaggaaagaatacacttgggaagcagtgaaggatggattctagtctttggagtctttagttctgccagtattttccagttgaatggaaaattcacctcccagtttggtttgggtgacaatgaaaggattgttagacctgaatgttttctagaaaaagacagagatcaataaggaaagaagacaatgtgaatatctacatatgttcttgtaatttttctccattgttttttgctttgatgaacaacatcattatagaaataattaatgttaattaatatctgtgtcatttcttgtaaatggtagtatattattgttacaattagaataattcgtatacagcatagcttagtgacatgataaatgacagagtagaatatgttgagtcttatccattttgatatattagctgattcacttgctcaataaagacaaaagaaaggcagagaattgggcagtaacaacagcaacaactataaatgcatggcggctacattttcaggtttttatttttctgccaagttcctgagtaccgtgggttgttgacattttatatttcttttcttttcctgttgttaaatcttagtccctgattgaaaccttcaagaataggatcatgaataaataaagcaaaggaaaataaaacatgacttccacattttctagatttgcatatgctatattatacttggtgttttatttttccaggattattcatgatataatagacagctgtctacaactctgatttatttttcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatggtatgctcatactttgctgtttaaaaggggggaattctctaacaagaaaaatgtgattactttaagattttcctaagattgtccaatactgaattggattctgaaatcatctaaatgttattaatgagattaactttggaaaaaaattgccttttacaaaacctaatattcttcagacaagcatccaaatactaaatgaaatgtgcttctgttgtcctctcttcttacacagaagtggcaactacactaaaaacttaaatgaaggggttttttaaatcaaatgttcaaaaataatttttactctccatggcactatatcaattgcctattggtaaaatgcacttgataaaaaacttagggtttttgtattttataaaccaatagtagctgtttttatttttctcacatttgaaaacaacactgttgggccgggtgtagtggttcatgcctgtaatcccagcactttgggaggccgaggcaggtggatcacctgaggtcaagagttcaagaccagcctggccaacgtgatgaaaccctgtctctattaaaaattccaaaaattaactgggtgtggtggcgggtgcctgccaatctcagctattcgggaggtcaaggcaggagaatcacttgaacccagggacagaggttacagagagctgagatcgcaccattgcactccagcctgggcaacaagagcaaaactccgtctcaaggaaaaaaggaaacaacactgtttatactgcttaccctttctattcattttagatggttttatgtgagtctaaatataaaagcaagcaacagttcatatctgtaagtctaatataatggcctttattagacattagcaagctgttctttatgtatcttgttgccatccaagtaactaaactgtactttgtctaatttctgtgtgttacttcttgataaataatatgaacaaatatttatattagtattttaatgttcacatacctgttatagcactacagtatattataatttgattgataatatatttcctaatttagcaaaaacatataaaaatatctgcaaatgataatctaataacaataagtcactctttggatgtaagatatttcctttcaaaatttccttttatgaattaaggcatgtagaaaaaaagtgtgccatatggtgaactgaggcaaagctaaattaggagtcagttcttatctttcaatgaagggcttaaattaagtgatctctgaggttccacccccttctaaacttcttcttaagtagcttgacagtagggctacattttttttcttttcttttcttttttttttttgaaacagtcttactctgtcatacaggctggagtgcagtggctcgactcggctcactgcagcctccacctcccaggttcaagcgattctcctgcctcagcctcccaagtagctgggattacaggcacctgccaccatgccctgctaacttttgtatttttaatagagatggggtttccccatcttagccaggctgctcttgaactcctgacatcgagtgatccacccgcctccgcctcccaaagtgctagggttacaggcgtgagccactgtgcccagcggggctacatttttatttgagtttcataaaacagaatgttttttataaccacgtattcccaagttcccttaagttctgaattttagatcaggtgtgtcttttggtgcctaccttctattagcttgccataaaagaggttattatgccatagtttttacaaatacttataatttcaaactctcccactctgaaagtggaaatgaccatcatttcatgtgccttgctgtttttgttgtaataagagaagtgagagccctttaaccacatttagctcaaaatttgaaggaagcaatatagttcggaaactatacatggagttactcatgttcctaaaatttctgagaataaacctaagacttatttaagacttatttatgatgaatgtgcttttgtcatgtttgaggtaaccaaacatgattactttagctatcatgtttgaactggcacctaattgaagtagcaacaacatttaaacaacaccccctttcctaattaataaacacacaaatatccttatatcttacccctgccacacacacacacaactcaatgcatatttatgcaagaaagaatgattaggggtaattgtttcataggcacataataaaaatgagaagtctaactacagattcaatagctccaaaaaatttctatcttttcttttaaaatgggataaatgttataaggtctgtgtcacactaggcactttgtagcccatgtgttcagttattaaagtatattcacatgttttattgcctacccttaaaaaaaaaatcatgtcctaattggtaatggtagactcagttacatagttttgtgctgctttagccagtcactctctagtaatagaattcattttgatggtatttttggatatggtttgttagtttgcccttctttcccacaaacaaaagaatgcagccaggcttatataatctttttcatattgcattaaatttttaaatgcatttttcagtataaatatgactagactaataatcaaggaatgagttgctttggaattttaaattatgccctacattgatcaaactcatgactgtactatttatcttatctaaaatagttttgtaaaaatacaatgacattaactattttttgaaatattttaaattctaattttaatatcattttcaatcctagttttattttaatctctgttttgaataatttttccagttttaattatattaagtttcgtattattatttcatagtattgtcacaaactaatcccttctactatgagcgtaattttttctttttgtttaatatataatatttaatgattgatacgtaaactcttccatgaagtatttgcaagtaactctgtcttcaaatcagcatgtgagcttcactttgtacatagaatacttgatgtgtcttaatgttcctgagcagggaaagaatatctaaatcataatctgttgttggaaagatcgatggattatgatgatctgattaagtcagtgttactaaattattgctgccctgtatacatagaaaaagaataaattatcagccacctaataaaaggacataattttataaaaagaattctgggacatccataaatcatgagagcaaagctagaaccatttcccgccagaaccctaaggtagaatttctatttaatttattgcatacactttttaatggacgaacagaattttctgtatgaggttttgttttcattttttattccagcattcaaaaaatcaatattataaagttagctcagcagaaaagcctggtttggggacatatttttgagactacaaagctatttttgaaagtacatttattacattttaaaggctataatgcttatctaatataatcttgccccacccatattttatttccactctcttttccattttgagagttatattataaaggactttcaaaaaaagtagctgaaatagctgtcatataagtctcaggcaagggaacaaaagtcagcattctgtttccattaaaagttgttgatgtggaaatgtgaagtgacattccctgcaatcagtagactgccatgataatggttttagtaacttcatatagtatttacacaaatcataggtacagagagacattttctgtctataattgtacacatgatcttccttcaaatgtagaaagttattgaatctactttgtttgtgctcacacctcacctcacctgtttgtgtgtgtcttttagttcatctaagtatagttccttctctcatctatgatcatccaagtacacgacaagtagtatgacactctcttgtccacaactttgccacaaacttttgtcttacaaatgcaatctataggtacttgtagtgaattctattgtcaaaacagaaaaactgtaagagcatagaaatacaaaacttctagggaaggtacttcccaattctactcctttttcaatgtagaattatacaaatattttaaaccatccctattattgaacgatgttcgataaaataaatctatgccattttatggtatttgtaggctaaattgtgttaggtaaacataggcagttattataattacaatgccatcaaatcaacatttattcattaattggatattttgctccctttttcccccattagccaccttctatgagagatacgtaaggatgaagaaatatcttttccttcaatataatcataagtgtatgtcatttgcatataatggaaacaacaggtactcttgcaagacaaaccaatgcccatggcagccttagcaatagacacagatgtgcagaggggctctcactggccctctgtctggatcagctgcacagccttgctggtactgtggagcagggagagagcggatgcattcagttaacttctctcatagtcttcggctgacaatggcttgaacatatcttctaaagtttagtgctggcatattttctgtttattgtgggtttctttcctcaatgtatcaaattatgttgcctgtctcagaggtcatagtatcattcatagtctccttgtagattgaaataaatcctgctctcgtgagatatcattcagaatttcttgatgctcctagccacaatgcaatgtatttcccttgatccagtgatttttaatttatttcaatcctcacaaaattgctatatactttgaaactacatttctggataatgtcatgtgtgaagttcactgaaacgttagattaagggaaaatattaattaaaaactatgcttgcccaatattcagttgatattttcaaaaagaaacacattttttagccaagtaggatagatactatatattttaaaatattatcagaactagaaattggatattcatgtgaataaatagcagctaagtatttaaataaaatatataaaaggaaaatacacgatagcgaaagaattttttatctggtattttgtcaatagaagctggtgcatcattcagtgttgtcattgtgtatgaccagttatatgacatttgcaaataaggactgaagcaaaggctcttcaaatatggtcatagctgaggacacttccaaagtagttgtgcagatcgttgagttctaaacaagtctgacattataaactagtttgattcttacctttgaataagtgaatttcctttaaaaggctgaagcagtgacatttgaacctatccatctgtaataactctttaaatatggtaataatcaacactgcctttttaaaattacagaacatttaatacatatagctataaaagtaaggttggctattaatggacatttcaattcattttgctatgtgattcggctttccagaccaaagagtgttaattattatcgtaatttattatttatcaactttgtttatggagactctttgggggatttgcataatcttcaaaaaaatctttggggaaatacagctctgttcttgaaacaaattacaaataagatcctcacgttattagaggtatacaacagaggaaactagactacataatttatgcatctctctaaggtgatagaatattcttttgaataaaaataactttgcatttctacattttctgcatcagaaccttatagacttgctttaaattctcatatatcgaagtaaaatcagagaactagtcatatagtttattttgtttttaaggacacatttttatttatttttctttatatttatttttaatcctgtttatctagcttatctgatttactttttctgtttctaatgtaagcattttcataacaaaaaattcatgtgttttgtagtgcctggtcccgtaccagtaaaatctcttcaaggaacatcctttgaaaataagatcttcttgaactggaaagaacctttggatccaaatggaatcatcactcaatatgaggtattgggagaacaaggaagttaattgaaatgtggattgaaggactaaaaggaagaagaaaggaaaagttagagggaaatatggaaaagacgtaaatgaggattaggggattaaaatcattctcctttgttttaatttacagattctttgattccaaaattaagcgtcaaaataaatattttgtatggcatctagaattttcaaattcttaaaaaatgcatgttttttgttgctgttttgttgatttagggaagcaggatagtcattatcagatttacgatggttatagtaataatcacatattaaaaaaccctcattttcctttttataaatttaagaaactcctatcatactgtgatttaggagaagccattgaatttcagttgtttcagagtaaggaataatacccaaaaagcaaaatagattataaagctgacttttctagagcttcatttcaactttgaatataaaacattatcttttcaaatatgagaaactaaaaaagaagaaatgaaagaatcatttaagttacacaaatgtgtagttctgttcctacatagcgttgattagatcataaatgcttaaatttctaatggctacagagtgaattatggaaatgagaatcactagtacaatgttatattttgaaactgtgttcacatatttgaatactatttacatgaaatttgttatataacttgaacaaagtacagaatatgttaataataataaaaatttgttgaaacactttctgtgtttcatatgcattaaagtatatggctataagattttttatgtacgcataatttattgtggtttttttgatggaagaaaatagatgtatattgatttggtcagctataactccggtgtatctgtagatagatgattgattgacatatagacagaacttcagaatgacagaaataacaatatcaacatgagaaagaaaagaagaaaaaaattaccattgactccacatggatgcccttgcatactaccttatttatacagagtttatttacagtttcttatgatggatactagatatgtaataaatgtatttcttaaaacagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcaggtatgcaaatgaataaattacaaataggattgattatgccattggtttgtaatggcacatcctggagaatcacatataaaccaagtgtagttcatcttgcttgttgaacctttaatatagttatgcataaatgaaagcactttaaataattatttgaatatgaattatatgtccaaaccaaaacacatctgaaatagtcacttttgattgacagtggtcttaaaaaaattatactaaatctttattaaaaatctttcaaaattcattataaatcctaatagatcttatgatacttttgaagagttgataattattatggtgtcagacctttactctaaatgaatgttatcaaaaaaatggtagaagatcctttctctagtattatagtactacataccttgtttctgtttcattttccctgacattatgataattttaaacaaagatgggcttttctttcacacttaaaaatcttatataaatacatataagttttaaaatgggaacgtacagaagaattttaggttgataaagaaattaaactttacattctattgtagtcacagttgcacagtttgtatttgactagattgtttacagagcttatttctccttcagtcagatcatcagttaaacctgattaaattcttgcaaggagttagctttgtagtatgccctaaatctactaaagtttatataatgttttttcttatttaagattactaaaataaatacatattgtatatgtaaatgaagagttaaatttgaaaaataaattatttaaaggtcaaccacacaatgtagtaaagcacaaattttgactttgttaattctttttgttcatttgtgttcatttttattatagttccacatggcaaatattaatgatacatcattaatacccataaaatatgtctttcatttttttaatctataccatttgcattaaaaggaagacatgtactttccaaattattttgagtctaaaatgttacttgcaaacgtgttgagtataatacaaactttaaaaatttgtatcatgaataaaattagctattccattatgagctataattccttggaagagcatttgatttatcttaatattccaataaaaaattaaagtatcatccattatattataaaataacaatgttttaaaattgcagttttctttcctgagaacaattacaaatcatgaatttaaaatatgtattgaatcactttaccagaaaataagacttggtgatgttacgatgcactgagataggttttctaccctctggaattagcagcagtgctataattgagtaagatctttcaatagagacagctacaaaatttatataaactaacaaaactgagaacattgaacaaatgtaaatttttgagagccataaatgtttgtgtgtgtgtgtgtgtatgtctctcaaggctcagatactgtgtttgtgttgaacataaagtttataaaaaagaccagaacatccatctgattttttcttttaattattcaacttcacttttacttgtattaacctaagtgcaatgagtacttgattgtactttaaaaacttggttgcaatcactttatgttaagaacaattattaatcacatctaagattaataaatttatggttagtgtggttctcatcattacttgaacttttcagataatttattgtcaaatttattccctgagtccggtaattacatttctcagcatttaaaaaaataatttaaataacagtgaaatcaagttattgcaggcataactgttgggggaattatttatacatacacatacattcacatacacacatatacacacatacatactacatattgtgcatgtattaaattaatatttgttgtttctgcttcctaaaaaactctcagataataattaatcttctaatgtcactgctccttttcttccatctagacagtattttaaacagattattgaaatatctttctaagtggtatccctaccttcagacttacccatcttcactgcatttctatatctatctttaatccacagatatttccttcttaaatattttcgcaatcttgtatcttataatcagcgggatgaagtctaaagatccacttggtgttggcattcagggtccttctttgcatgactcctcccatcctctacttctccccatgagcccaaagttcccggcacagccaacggcttatagctgttaaaacgtaccatgccctttcatattttgttatcttcagatattctgcttcctttctcagaattttagttcatcctttctcttcctgatgagtttttaccctttttttaatatttggcttaaacatcattagacaccctgagccttctggtttcatccccccactgccaatactaatgaaaaaagtgtgaccccccacccccagaccatcatcaccaacatcacctgagaactgtctagaaataaacattgtcaggtccctccccagaaatactgaatcagaaactctagggtagaggggctataatctgtgtgttagaaagccctccaggtgattctgatcttacaagtttgagaaccactgttttggcaaatggtcttccacttttggccactaacattttgctataattttttgtttgtaagactcttacttttcataaaatgtgaattcctacttttaattctaaatatcagagaccatgctttgtctttatattcatagcatttctcataaaacttggcacatagtatatattcagtaaatgttcaacgaatggatagagataatgcacacatttcattgagtatatactccttaaacagctttctacatgaaagtcatccaaagctatttgaggtaactctttttccccctcaagatcctagtccctaattaagcattatcaaatatttaaaaaaattataaatttattctttttaagaatctggcaactaatgtccctgatgaacaaaagctaagatgtccattatcatttaccacacttcttggtatgtttctcttgtgaccagagttgtgaaaaacacattagcataagagtactgtgtctttctacactataagatcataaacgacactgtttcaccaggtagcccttgacctcagctcttgctgttcatagctcctgatcgccatatgtgactccataagcactactgcccagtcttctcagttactaccttccctccctcccatcattactcacttgaaggtctcaggaaactaaaaggaaagcatcttcacaaaatatttggaatgtgtgtcataaattgccagacgattatttaaatttccacagcaaatcttggttttctagcttttgatattttaagttcccagagttgaaattcatttggagatgttatgctataaaacaaaatacgttgtagataattaggtgaatttttttttcctaacttaagattgtctgttcattctgacctgtgatatattactgtaaattaattgaaccttttttatctcattaatcactcatcagctccaactttacctgactatgaaggagttgatgcctctctcaatgaaactgccaccacaataactgtattgttgagaccagcacaagccaaaggtgctcctatcaggtaagaggagaaaactacagtagttctgccttatccacaggtatgtacatcccaagatgcccaagtatgcctaaaaccagagatgataacaaaccctatacagactgtactatgtttttttctatatatgcaaacctatgataaagtttaatttataaattaggcacagtaagagattcacaacaatcaataactaataataaaatagaacaactatgtattttaataaaaggtgattatgttctctctcaaaataccttattatactgtacttacctatttttggacgagtttgatggtgggtaattgaaacacgggtaactgaaactgagatatgagaaactaggtaggcagggttggggggtagtttttcttttactgtaagagttaaagaaaaaggagccagaaggttgcttagcagctaataaagtggttcatttcaaagatacattcattggagaatttctgtcaggagagttttatttttgtttagtttagtttggtttcctttggtttgttagtttttcatttggacaaagcctgcagatagacttgtagttaagagcaaaattctaagggcatttttgagatattcatgcactgaaccattcacctctctgtgcagtttgacttaagagcattggcctttttcccccctctagtcccatttcatttcacgtcctctcttggtatctatgttataagagctttgaagatatttgtcagaaataggatgagaaaataactcctgtccaatgcagtaaatcagttatgaataatttcatatgaatgattgaaaaataagaagctttgatgaaataaaagcagaatagttagaacacatgaagcctttttgaccttttaattcccgaattgttccttatcaagtattccagagtaaattgaatgttcagtttgccattttctttatcttttcaacagtaaagtctcatattatctaacatccccatctttcagaaaattgtgagccatgtgatttttaggaactaagtcaaattgttacaaccattttaatttctgcacatttgtaatcagatgaatatccaaaacttaaacaagtttccatttgaaacgtgattttgtggacattttgttatcaaacttctaatgagaaataaatgaaggcacagaaatccacgtaggcacttcataattggtttatatcaagtcgtttacatattcagttaaaaataaaactaatgtttgttctttgtgtaaaaggaatacatttgacttcgtgagcacgtattagccatccaaataaccaaaaataatcctagatcactggaaatgaagaaatattttttcttaatttaagaaatgtattgacaaaagaatacaaatcataaagggaactcttgagtcttgtctggctaaaaatcatgagaacactataccagagaaaaagagttggctgagggtgtacttgtaatataaacacttatgaaacactggctacttgaaaattcaaagtacgtatatagtgctgttcatgaatcaatgatctgtgagtgaatctgattgctgatccaaagtagaaagagaaaatgcctgcactcaacatcttttcctattgacaagtaatcagggtcattcacatgttcctacctgtgataaaatttactttttaggtgttcacttctgttactggtgcttaaatcagctaccagctacttgcatttatcttttaagagttagatatttgggtgaattcaactttattttacgtaagttgcaaacacagcatatttttattatttttgcatcactgtactatataatgtaacttacattaactctttattcacttaatcaattttttccacaaacattgattgatcatttattatgccagtcactgtgcaaggtattgtaaatcaaagataaaatgaccacaacaaaacacagaatctttgcccaggtttgtcatagaccatcagagatgcctgcagccttgtaaatcatttgctcatagctggtgttcaggaattttgttaactcagtatgttattgatacacgtttttaaatttaaagtcttttactttattacctttatataatttctaaagaccaattagaaacactcatctttgtatttgttggcaagatttttgaccttttctagaattgagccagaggctgagaacttcaaattatacattgttggagattagtgctcagaaaaataaatttaaatcctggaatattacaagaagaagtaatttaataataatataaacaacagattttttttgaagtgaatgttactaccaggaaaataaaatctgctttctaactgatatgctaatcccaccaagtccatctttagtttttgtaatgacttacccagttcacctacaggtgggtgccaggtggtgggaccagaatggtctagtcaagtaatctggcttcagatgagccctgcctcctttaccctctgaatcctttgtgctgtctttctttcctctgaccacattcctactttcagtctccctaccagcaactgtagccttatcgtgaggcttatctgatccagtgccttaattttttgaaaatgaagattcaatttaatgtaatcatttttccttaccattgaatttatggtctggtatctcaaatctttgattggattcccatcactcacttcaaatgtacttgaagcaattttactttccactcaattttttctttgtttatgtcagtctgtcaaaatctcttctctgctaatgcttgatgctattctactctgtgacccttccccctgccacccctgtcaccttcccaaataaaccagaactacatattatccaactaaatctgagagcatccaggagttagcttgctggctgtcatagaccctaaatactgggttctgtccttccctaattatagcattactagcctctgccattttgcatttcaccatctattcatcccacctccagtggaaatatgtattctttctgcctggtcttcctaatatcaaacaaactccagttctacagtcctctgtcataccaactagaaaatcttgttatatagagttttcgtgtttagttttattaggaaagctaaaatcgccaatggattctataaatttgttgactcaataacattctatatgtgccaagagctgagctgcatacttgaaatagaaatctacttaaggcaattagtatgtgcacccgtgtgagtggtagactcctaaattaatgactggtaacaatgctgtgtgataagtgcaataataacagctagaaaatgtggtactaaagctgaatttgtgaggagaggtagaaatgagcatggccaaaggtcacaatgatgcatttacgaattgcagatagcctaggtcatggagagtgaagggtctgtgggagaattgacagcagctgaagctggagagacaaaacagggagcaaagggagaggttgtttagtgccagccccacaactgaaggtgggcacaagaaggactgtaagcagaagttaccatgggcagttttacgtttttagaaagatcactctgatagaaacatagagaatggactggggataatccagaaggctggagtagtccctgtgagaagtgctaatgggccattttaagaaagtagcaatggaaatgcaggtaagactgtggctcctacataaggttttagatcagtaggatgtgtaaagcttcatgggaagggagtttgagtggagactttaggtgagagaagatggtagcttttatatttgaagtggtagcagagcaaaaagacatctcagaattcaaggttttgttttttgaggttattaagtgataaatattttcagtattgctaccccaaatcaaaaaagtaatgctctctctatgaaaagaggagttattttatatattttgcctaccttaccaatattttcaccaagttttaatctctaagagatcatggtgttgtgcttacataagaagtaatgaccacagtgaaaaatcccattctgcataatgcagcactaagtttcaccaaccacattgtccttctgttacccattactgcttccctatgctaatgtagaacatgtgcgatgcagtgctggcaagtgtggttctttgacgaaattaatttttgattttataatcattctaaaaactgaacattgttgcctgacttaagtagaactttgaatctccttaccaactttttgagatctatccttacaactgtcatcacttgacaatcattactgtgttcaaaatgaatattgtctacatttagaatcaattccctagaatacataattccttttcttttctttctaaaaggtttcttcgtaaatgaattaaaactctaacctgggaaaatataattacaaattataatgcatagaacgtcccatttattaaaagattgacccaatatagctgtgttttcaaagaatgaaaataacagcagcatgttgtaaaaacacaaaatagtttctctgtggtgagactgtttattgtaaagttaataaatgaatatatattttatttcagcattttccaaatagaaactctacccattttgcgctgcaggaagctacccattctaaggttactttgttttgtggagaacatctaatttgcatttcataacattaagcaccacctatttagtttgataattaaaatatagtcatgaaataaagtcaaaaccaccatttcttccacagttaaattaggaaaagaaattgtctgatgttctaagttcactgatagcttaacagacaaatgtatgttagggttgcatagctttaaaatctggggctatcctcatccacctgcagaatagtctgtttcattacataaatttaaagatatcaaatagttctaattttcctaaccactatcctgacctagagcttacttgaattccaaataaaaccatcttgaaatttaactagagatggaaataatctttttgccctcttttatgggcataaaggtcatatggtccaattagatcaaatagatgttactttaattttatgtttattctctagaatcatagtaggtagaatcattataatttttctaatcaaaaataggaggaagtatgcccttcttgttaaatcttctttctggcctctagaatcccagtccacagcttgcttatgaccttgtgagaagccctgagccagacctgtcttagcttagcaactctggaattcctgacccactgaagctgtgagataatgtttgttgctttgagctacagaatttcagggtaatatgttatgcaggaagagattatacatgtacccaagtagtataaatcttctctttcttcagatttctgcccaacggatacttttatcacataaggatttcttgaccaacccatataaaatagcactctgcattcccatcattccctctttcccttagcctgctttatctttctctagagcacttatcccttcttaatatgtgttggttttctgaatttatttttttatttgtgtctccccactagaatgtaaacttcatgagaacagagacttttgctactatcttcattattttaacctcagtacttaaaataattcatgatatgtaacagatactcaataaatatttggtgaacaaatgaactggatctaaaaatataacagccacattctgtagtaagcttatcatctgctaaaggaaagacatatacctaaaaaactatttttaacagtataatatcaaatcatatttgtaatgtaccatgttggtgcatgtaatgtgctacggccacatactgatgtatcatataagcaataaatattagacagcaatgctaggtcttttgttttttccaccctagagtttttgagaataccatttatggttctgataaatggatctttggcattataattgtcagtgggttaggaactagattaaacatgcatccctgtgattgtgacttctacccccatgtcatccttcagtcatcctcatcttaaaaattactccattgcctttagaagacagagtactgaggaatgaagatagttcaagaagccttcatggcagaagtagaaaaactagacaagaaaggcagaaattcttgactgtatgtttagtatatttgggtaacaatggtcataccagcttcgaatggaaaataaatatcaggagataaaacaagaatggagatataaggtaaggaatgtggtaatttatcaaccccagcgtaaaaagtacagagtttgactttgaatttgactgtacttcaaattttaatgttgctattatcctgggctagtgatatgtaatacatgagatattaaacactttattataaaacaggttttgtattagctgattttgccaactataagctaatgtaaatgttctgagcacatttaagttaggctaggctaagctatgctgttcagtgggttagatgtattatattcatttcaatttacaatattttcaacttgtaatgggtttattgggacataaccccatcataagttgagaaacctccatataatgtagtaaaatatgtcattttaattttttaaaaaataaggaagtcacattttgtgtattgaatgattaatgataccaatatattgatttaacctaattacagaaatatttttgaagtttattaaaaggaatggggaatatattaactatgggtagagtgattaaaaatattatgatgactttggaatagttttaattactaaagtactgagctcacctaatatttagatctagctagagtttagttccattaggtaattagacaaccagaagaatgaagaagcacaatcccatttcatgtaattagtcaactcacttctaatgcgatttcttatttcttatttcatcttttaattaatttgtattgataaataagaaaataacaaggacagaaacagatttaaaaattggaaatgtggttagagaacagcctttcagattgaacaatgaaggaaagatagtttcttttaaacatggactagtgtgactttttgttatttttatagctgtttttcactaaatgtaaatacttcttaaagactcaccatgattacaattgatttctgtgtgagttataaaaatgcctcttcaatgggcatgaaaaaaggtagaaatagatgcacaaagtgatgcatccagaaagacactgactaaagactgagcccaactaaggagagtaaaatgccactagagaattttgagggatactggtacaaggaaagatacttttcatattttcagtatcttgaaaaggtagcatgctgcagaggtccagaacagaaagacagcagtacagcagacaggtgtatatcaagattttaaactgaaacgggtatttctgggtgatgttatagaaaagtagtacaatttcagtttcgtttgggtgtaaaagcaaaagggagtatgagagatgactttaaaagactctgaagatctacttctgggtagctgtcccagtcactttaaatgcttaccatggacagtcacaggttcctaagtgaacagagttgaaaagaaagtatacattttagttttgttgtcgttttaaactgtatcaaacttgagaggggcagaaagcattctaaagatggtagaacactagaagtttcagtaaataaaagtgaatataaggtccgtgaaaggcaggtgttttttttttaacctctctatcctcagagcctgcatgatacctgttaaatatataattgttgaatgaaaatgagttaatggatacaatgtcacaggaagaaaggtaaatgagaaaattcttactcttcaaataatgctcgggatttttcaggtgaaaaatgtactttcatggagaaagaaaaagagtatcttagatatgtcctaagcaaaaatatcaacagaaaaggcaaaagcaatgtattcatttcataaacacttaaacgtccattatcctatttgaaaccacatattccagtgtggtttcaaataggataatgggcgtttaagtaagtataatatgtgaaaatgtaatggctattgtatcagcttttggagttaaacatatttgggattaaaaatatctagaaactggggtgaatgttatatcatgaagacatttctcctggtatgagtggtggtagagtgggagggttatagagtgcggtgaccaggttatctccaactagcgttccatctaatgttactcattgcacaaagaatgttttagaaagtatgcttggaagccagttctcagaagtctttttgtatttatgtgtcttagtttgctcaggctgctattacaaaatactaggtggcttaaacaagaaatatttctcacagttctggagactgggaagtccaagatccaggtgctctcggatttggttcttggtgagggcccctcttctaaacctaattattttccaaaggccccctctccaaatactatcactttgagaattagggttttaacatgaattttgggggagggggcacaaatattcagttggtaacactgtagtataaagtagagaatgaacaaagtgaggttcctggtttaagttttaaggggagctctattcttctgcctcagtttcaatagtaacagaaatataatacttcatttctgtaatgaccattcaaagaataaatgaataatattggtagagaaaagatatataagattaaagtgcatggcactgtaatttatatttgtatataaattatgtggaaatcattttcttaattctttatgaaacaagcatgttacttgtattttagaacttataaaattgaaataatttatctttcattttaattgagagtagggccaaatctgaaagttcaacccaaggcattgatttttattttctatgggaccatacttaaggctctttcccaaagagcctattgcaccttttcttcctttactcttctccaacactggcaatttactttgctcctcacagatctagatagacaagctgtcttgcatgaagtatccttaatttgtaatgtagaatctctgtcaatgtaatagaattagttaagattgaatgttcactagattttgtgtttttttttctagaggtatgggataattaatgaagaatctatttttaaggattagattaatgattaacaaggataggtaattattattattctttagggcaagaatataaggttacatttgtttggagagcatgtatgagggagtttatatgcatatgtggatgtatccacaggacatgcaaatgtataatatacaaatatgaattataaatttaaaataaaacatagcatatgtcagctatgatcattctcgtctttctccagggctatgcgtatgtattttctatatcttaaaattgacaaatgcctgctccatggatgcctcagagaccatgcatcttgtcagtagcattcttagaagcttagcaaccaacttggcagaggtatagggaatgatgcagcacatataatttgaaataacatagacttctgccttgcttgctcaaatcacaatttctaacattaatacaagttctgttatctttttagaggaaacaagatggatatgaacctactgatttattagcaatattttaatggaaaatgggagcttaaataactaggaagaaaagaaaatctgtaatttatcaattaaattatgatttaactctttcttttgatgtccttttgtttaatctatgaagatcttttatttgtaggcataagagtttatattaaattagaattttatgccagagtctaaactgttttaattttcatagatgcatgttcagtgtatctctctctctcctctctctctctgtctctctttctccctccccctctcctccccactcccctctacctacccacctctttctttttcatggaagtcttttaaagaatgtattctgttcctcctggagatccattgaatatcaatatgcagccctgcatacaatttatgttcaacttacctaagataccacatatatttttccagaatttttaggaattttaaaacattttaaaatatatttataatgtataaaatatattataataataatgtcaactttcatggtaatattttacctgaaaaaattttaacgtaaagaattttctactaaaaaagaatattgttaatataccagcttcagagttgttaaaaaatattgttagatatccgggggatctttattttaaatttgccttgtttttctttttgtttttttctctcctttgtaaagtaattgcaattatagaaaagttttaagacttaaagatatcagaaggtttaggttagagctttaataggccaaatgccatctgtttctacaatttgtaacattttattattaacaactccagaagaaggaggcggtctatttcggttgtgaggacagatttctgtccatctgtgcccgtattgccgcatgtcacttgtattttagatctacatagctctgagccagtgtagatgccatggcaaggtcaagaggtggagaagcctgtcagtacattctgtctctgaggctgtgacaaccacaaatgggtgcttctagcaccgccctgaggcagtcattctgttagaccttggagctggactttctgtaatatcatttcaagggaaaatgttaactttaaacatttaaaaatatcagacaaagaactgaatctatgatgtgtctttggttaatgtcagaatccttattagggtggctcattcctcaacatttaaaaatgttgaaagtcctacggtgattgttcttctttttatcagtttctttgtaactacagtgatgttagggacagcagcatctatatggatttttcattttattgcgaaatagctgaaaagagtataccaggttaagactaactttaaatactttgaaatgtggtgtgttaatagtcaaccccttaaaaaaaatcttagtatcttaaatctctaaatatgtgtgtatatatatgtgtgttctttttttcttttccccaaagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggtgagcttcctccaggatttgctttttccctgctttgaagaaaagctgaagtcaaattttatgaatactcagtagcatccgtcaagaaaaaaaaaaagaaaaagaaaatttgcatgtagggggttctgttctcaacagtgtgcgcagttttggggctacagtagggctgaggccgcacgccagttccatttcacagggttcctgtttcctagtaactgcttctactcgagccttcctcaggaaagcccacaatagcaattgagagtaaaatgatttgaaaacgtgggtgtgctgctgctgggactccaccctcagtaacgatcaggcattgttctgtcttccttgctcagtggtggcacacttcaagagattaaatttactgcaggataaacagaatgcgtgttccacagcaggctaataaaaccttataaacttttcagggttttcaagccaaatagtaaataacatgtaacaatcctctgattacaaagtaatagggcgcctgtggtatatctgactgaacctaaacaaaaggcagcctggcgatgactggctgctgagccattacagaaggctgctctctgtttccctggttgcccctccttttcccattttggacacagttgtttttgaacactgctgctgatcccaaatgaatattgaagaggaaaacacaacaggacattagaaacgaccggcagttccgtatgtgggaaaacaacctggcctttcatgcctcatgctgttctctttggaagattttctttcctaaaacttatttttatttatttatttatttatttatttatttatttattggcagacagagatagagggaagacaaatgttgaggatagaaattttcacaatttaaaatccaatagaatgatgacattttaatagacttgaagccgtataggaaattgctgggtttatgtaattgagtccctaaggtgagcacctgggagtgatacatgatatacaattacatcagtcatattatatcttaaagagtttaattggaagacataacaatccttttgcatttctgcaggggccgtgagagctttgggtattgattggctgcttttgaatcaaagctttgttgtttgcttgcctgtatgcttggcttgtaggtagcaaagaaaaaggccacagcatcttctaagatgtgctccagagtcagaggctgctcatggttgaagatgctcttctcgtttacctttaaagaactgaggtctttagagagtagtccagtgtccactttctgcctacatatcattccataccactgttacaactgggctactataaaaacagaacacaatggaagttattagtccattctgggtataatatagcattgagtaggaagcatagttttgtgtgagggttttgatctttagagaggttccaaattaactttggttatttggtctattataccagaggagtgttaatgaatgtctgttacttataaaggattttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgttcactggctttgataccttttctcacctcttgtgtattcagggatgtacgctgactcaattaagtcctagaggaggaagagtggggccaaaagtagctggcagggacatgtgtctcctactgccacctgacagcgttaaaaataatcatattttttcttgtcctttcctactgcttctactttgtatacccgctctgtctagcaagaggaggaaaattatgtatgctgagaaacatttaactcctaatagctaaattaaaagaaagaaagaacagataaattacaccataactatgatgtaatgttttgatgatctttctaactgctatcatttagctttttagtcatgctaggatccagatgaaagtatgtaatgttcagctttggtctcagtctacagttctcagatgaaaattaaatttatatttggaactgtttttattagctttgcaagtacatttttctgatagtttacgaagcactatacatgaaaatagaatgctatactacttgtcacaaactaacctgtttcattgcaaggtaaaaacaaatatttacatctctataaaaactaaaatatttttcaaagttcttactttagatttttaagtatccctaggggggcatattttttaaagttttcttaatattaaaattctgttgtttataatccctttttatgaccccagatggatcttcataataattatagtttatgaaacaggaaacattatctgtacattgactcttttttttttcatttttactctatcaggaaactaaaacccagtgcgtacgcattgctacaaaaggtaagaggtttgctttttttgcttgttttaactactctcaccccctttctaaaatggaaggactttgttccctgcttcagggctaaatatgacatttctgttatagttagttctgtgactcatgtgggtgtctttaacaactaatggggtgctacttcccatcctctagtacttgactgaaggaatcttgttatgataacaggaaagatctagaaaaccttagaagggcttatttctgccatttagtgtctgaaaaatcttgtgctgctgatcaaccaatatcttaggaaagcgtcagcaatagcagatgaaaatagcaagttgcttgtttaaaaacctctattactttccattgtagacaatcaaacataaaaagaaccaagctaattcatgtttacataagattatagggatagagattagtccatatcttcatcagtagtgcagttagcttgaagatcatttactttttttaaaacttattctgagaaaccagatctgtgatggctagctcataaccagggcaattcctgctgacctggcatattatggcttagctgcctagtttctttgacaagagaaaacatttgcatctttgaatgaatatttagagttccaagtgggggaaagtctcctacattctctgtgtttttaattcttcatttaagagttacttgattgtgccaacaaagaataaattgctacttggtgtattctagcaagagaaacatgaaaaagctgtctgcatgcagacgtgggcctcctcaaagggttggttcttggggtggtttgctgccggaattagtagcagacccacatttgtgtccagtagttgattcatttggggtaaaaatcaatggccatattctgtttgtactggcatctttcctttcatcagttttctccatctaatcatcagtctgctcaatcagcatttgtgctttactcctgatttgtaaggcaataaagaaagactttctctttgacgcttgtgaataataaagaagctttatggaagagaaaaaaatatactttttcaattcacttatgaagattccttttggtagtttttatttaaaaaagcaattcttaaagagaaaatatacacagatacatacgatgtataaggattttattttaaaaatttagcttactgatcaggaacgagagttgaaatttttaaaagataatagaagaaagcatttaggtctatatcacctgtgtttttccagatttaaagtagaaccaaaattgtaaaagtgtcccacattgacctctgaagttctttagatatgtcatgctatgtttctgtaactgagaaatggtagctatatattaccctaacataacttttttattcagttatttcattatttgctcttgcctgagatgtttgtgtccttttatcgctctctcgatacaaatttaaaaaaatgacaaatatcacatgatatttaaactataggaggattgagatcctggaaacagtcttaccatgtggcatagaataattgacagaaactttgaagtggtaaaaaatagtccattatttgtctaataatccagctctgctacacttctggatctcaggaatgcagtgtggtgtggtgtagtgagtaagagaaaggactctggccttacactatctgagttcaaatattgactgtgtcccttaggaattttttagtattgagaaacttatgtaaaccctcattccaaaaattaaataatagagtacctacaccttcttattgttgtgaggattaaaataacatatataggccagacacggtggctcctggcactttgcaacgccaaagtgggaggatagcttgaggccaagagtttgatatcagcttgggcaaaatagcaagaccctgtttctactgaaaatttaaaaaaaaaaaaaatgttagccaggcttgatggagctcacctgtggtcccaggtacttgggaggctgaagcgagagcatcgcttaagcccagaagttccagtttacgttgagctatgatcgtgccactgtactcctgggtgacagagtgagaccctgtctctaaaataataaaataaaatatatatgaagtgcttaaatagtgcttaacatattataaacagtacatgtgttaactatcttatcattatgctaataattttgtacttaagagggacataacttatgttagacagttatgaatgaaatatgtataaaaacaaatctaaattttcgtgatcgagattgctaggacaggggagaaactaagggttttttgttcgcttgttttttaatgtttctgccctggtctaatatattttcttctctgaacctttagcatttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagaggcatgaaggaaccttctggtgaaggagtggttcagtatttcacaggtgcatatgtaggtaaaaatctgtccaactgtacatttaaaatgtgtgcactttactcttataaatttgtgtgtggatatataggtagataggtaaagtatttcccaatataaaaaaatgaattatacattaaaaattgcatggccagagttagaaacagcactgagaatattatagaggagtctctggagtttgaaaggctcaccttgctagcttcagtgaaggtttccttctatcagacgaggtgcatcttcagtacataagccactttcagtgagaaggacaaccctgcccaggaatccctgggctgaatgaaaagggtctagaaaggacctttcttggtcctggatgactcctatgggcaagtcttgtgtttcagctgccctacagtcagaccctcccctgcctcccaacccccaccccctttccagtgtcagttgtgagtactgaagagctagaaccttgctagaaccttgctttcctaatatcctttgtatttagatcaattttgctgaaaagaacttagttctctggaaaatctggtgtccctccataagacattccagtttgcagtgtgtccttttaccacacaaattttctgttcaggccatatgcaacagtctgttgctttttttctcatttttttgaaaacttaaaacattccaaatgtagtctgggacaaagtaccttgaacaaagtgtgtgtttctctcactcactctctctctggaaattattttcacatcccctttattttagaaaaagttgtattttgtatggagaagccagagttcattgttacatgttagtatcatatttataatagaaaataaaacattttactaaaacaaaaaaaaattatttagccaaatttgaagctctgatttaatagtcttatacatcactatatgccagggacaaatacagagtgagagtcatattagatacaataaatatttgttgagttggtaattgaatttgaacaaaacgtaaggtagatgcttctgctttcacgtttaatcaaacaggttacagtactgtctgcaattatgaaaagtatcagagcaatatgtgagttaagacaaatttattaaataactagagttgtttttatttctttaactgtgcatttatattgtgatatatatttcatattctaatatagaatacttttgccaaagctaagactttattttagtaacaaagcagtcagttaaaaatataatctataaactaatgtgaattaaattaaatttaatcctagtctgtgtctatatcagttttattcaaatgagttttcttcagctgaattctgtgataggaagacagtttagctcaaattgtcttttcattgtaatcactgctattcttatgaccatattctatagcttctttgctttcctggtactcacatttcaatgtgaaggacctattcaaatgaattaaccagaatgaatgagttgatatattagagcacagagtccaaagagaatctagctattattacttcttataataagtcttaaattcgggatacaggacattataatgagagattaaaattctatcaagtgtcttaaggatggacataactaagtagcataagaatgtaccatgttttgctaatgagaaactctgacttcattggtggatgtctttaaattttacagtcaaagtagaaataatagctctgaatatttttatagttctcaagcataagatcagaactagaaattaaaaaggagtaacacatacaattttcaacattcatcttttcccagcattttgaattattcttaaagttggcgacagttcaccattactactgtatatctggaataccctgtgtctaactgatttcatcttaattcacttcacattggaccccggaacctctctctctgctctcattgctagtataagtagactcttctccaccatgttcctagagaaatagccaagtcaccgaaacagaaaagatatgagttgaggaccttcaagggtgcatgatcactgttttcatcccaaccccaagttagatggaagttaaatatttctttgctttaaaagttacaaactattattgtttgcatatggagtattactagtctaataatttttgacagaatgataactgggatgctaggatatagagagaaatggaaaaaaatagaacggacctgaagatgattcaagcattttgcttttatggaaattaaactgttttatgagaagatttctgacctattaccctctctttcctgaggagcctgttgcaggtaccttacatttatggccacgtctacgggagagaagtgatgacattcattcataaactgatcaaactgtcagtgttaactgtggaaaggatagagtttctaacctaatttgtaatgctgtaatcacatacttagaagagactggaaaaacataaattggtacaacctaagggaactaacttataatccatttcagcaaaaaattcaaaaggtaggtggttatatcatcaatattcaaaaatcaatagtgtagcagcaacaaaacagtattttaagatgttgtcatttataatgtatctctaaaaattagtgtaggaatatatctggtgaaagatagattacatctctacactgaacactacaaaatcttattgagagaaattaaacaatacctaaattaatgggatggcacaccatgttcatggattagaagattcaatattggtgaaatgtcagtgctcctacattaatgtgtagatttaaagcaatcaaaatcccaattttgttaaaaaaattaacaatctgattctaaagacaaaatggaaatgcaaaagaataagaatatgcaaggctactcttaaaatacagttcctggatgttatcaaggccaatataaagttagagtaattaagacagtgtggtaatagcacaagaataaaaattatgaccagtgaaagagaaactccagtaatagatgcacacacacgttcaccattttttatgacaaaggtaaaactgtagggaagaggggaaaaggtacccttttcaataaatgacagtttttccatatctatatggaagacattatatcttgacccctaactcacactatataaaaaaatacagctacatataagagttataacagtatagtttttagaagaatatagaacatattttatgatgttacaatagtcaaagattgactccaccatcctccaccagaaaaaaaaaatttaaacaattttttaaaaaaataataggcaaggattttttagacaggagatagaaatatgctaaacaaaaaggaataaatgataaattctacttaagacctctttcctgtcaaaagatgccattatgagagtaaaatagaatttacagaggagaaaagatacttgtaataaatatatctgaaataaggcatatcaaaaacatatttaaaaactattaaaactagtgaggagacaagagacaatccattagaaaatggagaaaacacttgagcacttaagagagaaggaaatacaaaatgatcaattaacctatgaaatggtgctcaacaggaaaatacaaattgaaaccacaatgtgattccactacacctataccaaaattagtaaaatgaaaaagtgtagaaaataccaagtcttaagaaggatgtaaaataactggaaatctcctaccatcctgctggtgggggtataaatttgcacaaccactttggaaaactgtctagcaacatggactgaaagtaaacccatgtcccaacaattccattcctgggatactcaccaaagaaatatgtatgttaatacacccaaaaacatgtagtacaaaatttatagcagcactgtttataaaagcaacaaactggaaataacccagcaacaaccagtagtagattggataagtaagttgggcatattcacataatgccatgctctaaagcaaagaatgcaaactatgactacacaaaataatatacataagtataaccaacattatttgagtaaaaggcagacaacaaagaatatacactttattgtttaatttgtaaaaaagaggtaaaataactaataaaagttaaaaggtatgcagtacctatatagatgtattatgatttaaatattatattatctagatatgtatctgtctcaggggttcccgagactaccctcagattcggtgattcacaaggaggactcagtcatcctgtgagttgtcctgttctcatggctacgacttattacagtgaaaggatacaaagcagaataaggacagggagaagtcacatggacaaagttcagaggaagccaggtgcaagcttccaagagcctcttcctatggaatcacacaggacatgcttaatttctccaggatggaattgggacagcacatgtgaaatgctgtctatcaagaaagcttattagagactcggttcctaaggtttttagtgggaactggtcacatggaccccttcttgctatcatctgccaagattcccttctcccagaaggaaactagacttttagcataaagcacattatttgcacaatttaggcacaatgaaccactcttctcagggaatgatgggaaacctcccaaatccgagttcccggacatcagtccaaggtcaactttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagcgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccactgcactccagcccgggagatagtgagagactccatctcaaaaaaaaaaaaagaaaagcatatttcaggtatgttcaggtatggataaagaaaacaacagaaagattaaggaataaaaatacatgatgacgtgaggtctttgaattgtggtggtaagtagatatagcattgaacagaagtttaagtaagtatagaaatctgaccttaggccccttaaaaacctgaccttaggcccttctcattgactacttcttaaccgttagctatgtgctgaataaaagctggaaaaccagagaaattaaagaggaaagagggaggggaaaacaaagtggaagcttcacagaggcatccacaggtcattccaaaaccatagtattatgctcactattagcaacaatctaaatgaagaaaaggagaagaaaggaaaagaaaggccacattgccggggcttacacaagtctaattccaagatttaaaaaaaaaaaaaaaaagaaaagaaaaagaaaaaaaagcgcttatgttctgaataatggacacttctggtaagggagccagaaaaaatttaaagacactttaagcatggccagacatggtggctcatgcctgtaatcctagtgctttgggaagccaaggcaagagatcccttcaagccaggagtttgagatcaacctgtgcaacacagtgagacccaatctctacaaaataacttttaaaattagctgggcatggtggcacacacttatagtcacaattacttgggaggctgaagcagggtgatcatttgagcccaggagttcgaggcagcagtaagccatgatcactccactgcgctccagcttgggcaacagagcaagaccctgtctgtaaaacaaaacaaaacaaaacaaaaaacaataagcaatggaggaaatgtttaggcaataatcatggcgaatacaaagacattaagaaaatgaagaggagatagaaaaaaaatgtataaatgaaaaaggacactgctaaggaatttagtaaccccaaattcatgaatggttataatccaatagaaaaaatatatccaactctacaccattacttaggtcttaagcatatttaaattataaatatcaaaacaagtatcacagggccagttcatttatatacattggttgtagatcattttcaggttaaactacccctttttaatttttgctattattttagtatgtttttcttattctttgagtcctttagaaagtgctttgagggctgtttactggaaaaagtgaattcaaattgctctttgtcaaaataaactttgtaacttttcagttttctaaagataatgatcaaatttgactttttaatgaaatagtttcttaaaattgaaagtgccaaaaaactttcaaatatatggaaagagaaagatggatgtgataggatttttttaactctcttatgtttaaagttatttatttctttattaaatcaaacaactcaggggtttaatttggatagaaataaaagtcatacagtcaccaccacagccttttagaaacatggaatcctaggatcagggaagttaagggtctatttaaagtgtcatttcatatcctcatgacctgtggcaaagcaggattataagctggtcctcctgacccctagtccgtggttcattcttctctgtgctaagtgttctccatggtcaaggctctctgagggtagggatatgaaattaaacatgaatgaatctgtcttcaaggagtttgtattcttttaagtaatatgtgaaacttaagtaaagtatgatacaaatgtgctatgttcaaaggaaaaaagacaaagtggctggaaaagtgtagtgagcaatgcttgtgtcccactgcaaatagcattagccttggattcagactagattctagattcaaatcccccctctgctatttattggctattaggatttgaacaagtcatctgaactctctgtgctgatgttttcttactgtatataaaatggaattggagttgaaaattattaattttcagaactaacaaaagagcagaaataatagatgtgaaatttctagtaaagtacatgtgagacatttttaatacatacttataattcattgctattattactattactcataattgcttatggtggagaagctaagagaagaattttatggaggaagtaacattaaatcttactttccaagatggacattattttgacagttggaaatgaaagggaagatgatccaattagaagtaattaggtagaacaaaagctataggactggaaaacatgctttacatctaaagaataaaagttttctgtctcattcatatcaatgcagggaaataaaagctggaaagtttatgttggtattggacagcatcttgaattcaaactgcattgtaaaggcaacagcaaatcactgaaagtttttgaagtgaaagcaagttaatcccagctatatgtaacattttgggttaaaaaaaatctcaatagcatatatgttagattgatgcagttaaatagtagaggtgaagaaacaagctgaaagcctggtgtagctcttttttctcagccttttctcttttcttccctttttttccttaaaaattcatctcacaaccattggggtggggcagagcatggtaggacccacaccagtgagagatgaaagcagcagcagtggtcccacagaccttgtcagagcctgagtcggatggaggaggcagtctcacagagtatcagcctcgtgtggcatttcagaagtcagttagattcagaagcttgtcttcatggggacggtgggtggcacaaccccatgtgggaagtcagagcttgagcagggagtagagtgtccacatgtggaggtgaactgttggggttttggagcccaactagggtgagtagaacatcaacacagtaggcaatccaccttgggaaatcagagcccaagtgtggtgaaaaggggacttgtcagggacgcatagcatggtgtgaggtatcagaatccaaacaagatgaagagcttgggggtggggagtcagactctgagggaggttaagagggtgtccacgcaagagggtggcccatacagcatgtcagagccttatcagtctaggtgtgtgaacttccaggcagaggttgatcatgtgccggttgcctgagtctgcatggagtgaggagcacagccgcacagggaaggaggtgacagcagagatggcagagattacgtgtgtggcagggtgtgggggtgcagggagaaagttaaaaaacacaggtgaaactgtgtgtataggggtgtgtgtgtgtgtgtgtgtgtgtgtgtgtgtgttccatacacatagtccactgagacagcctgggagcaacaacatactgatggaaaatatgcctaatatccagatgttggtgtctaaataccattatccaataaaagtacctggggctctttggataaatggctcattccagggctggaacaaggaaagtacaacatgaaactagattattattattatttgccagaaagcgctaaaaaaataatgagggcatagcaagaggacacaattgccaacctcaagggggcccctcattggctgaactagaggcctattacttgagaatcaaaataaagatggtgattgattataacactgaataaaataggaaagcacaagtccttactgatataaatagagaaagatggatgagaaaccaggtatttacatagtttcaaagtagctcccaaaaacttaataattataaaagggtacagattaacctcacattggaagagcctagcagatgctttgaccaaatgatgaaggtgaacagtatccatgttgggaaagacattatggtttcccactaggatgcaagaaaagcacagcatcacttttgtgatattccaaccaaagatgtatatccttaatctaaacatttaaaatatcagacaaatccaaattgaggatattctacaacataactgagctataattttcaaaaacgtaaggccttgaaagtgaagggaaggctggactgcgcaggctgaaggggaccaaagagatatagcaactaaatataactaattagatcatttagatacaaagaacatcattaggacaattgggaattttgaatgggatctgaagtttagacagtagttaattttcttaagtttgaacgtcattttgtgatctataggaaaatgtccttgtttatgggaaatactaaagtattctggataatggaggcatcagggcagtcacttactcttcatgcttagtaaagtgaaaacaagggagtagtgtatttgcaaattttctgtaactttgtgtgtttttccaacatataagtgaattttaaagctgttatactaaaatatggggagcagatgagtgattacattaaagaataagaaataaggatatggaggatatgatggtggagtacaagttaacatgtcttggtgtgtatctgctgtgaacaaggaagctgaagacttaaatatgatgctgaacttctgtcctgagccaaccacactaggaagatgtgatgtcagtcacagagacagaaaacactagaaacaaaggctgagattaaaaaaaaaatgatttatgccattttggaaaagccaagtgtagggtaccaaaaaatagctaacataaatgtaattggaaaaactagaaataaaagtgtggagaatgtctggaactagagaacttagaacttgggagtggtaaaaacatatgaacaagataatatagaaagatgaggagagctccttgcaggatacccatcttgagacagtaggaggaagaaagtgaggtaggagagaagctagaatagaagcaaccggatcgaaagatgcataaccagtggagtgccttgtcacaacactgacgaaaggaagatataccaagaaggggcttataaacgatagttaatattttaagcagcatggaaagctcaaataaaataggatgagaagaggcaactgggtttgcaaactgggatgtctatggttgagtttagaaaagggagcattcaattagagtgactgggcaaaaagatagcgaatagaagcaagactttagcatgaactggagctgagaaaataaagtggttggggagactttcttttccagaaatacattactgataaaaaggagattgctaggactttaatttaggaaagaattattaagcatggtagagactggagcatattttatttatcagaggaaacctaccaatggagcaaaaaatattgaatatatataagaaagaatacatttctagaggaagtaggcagtgatataattgaacaaatgcagaaacatatcttttaaaacaatagggaataattgaacctgtgagggcaaatggacaagtgacaccaacagaaaaaattgagaagtgtattagattatccatttaaacaaattaaatgaagtcctgtgcagagagtacaagtatcagatgtggaacaagagaccaggaaatttttaaaagtttgaaaattcttgaagaacaatgtgaaagaatttaaatctaagaacaattagcatacatactgaaataacatcattttgaaaatttttcagcgtgtaaaaatcattctaaaaaattcctagtatcggctgtatgccatgactcgtgcctgtaatcccaacactttgggaggcagaggaaggaggattgcttgagcccaggagttcaagatcagcctgggcaatataacaagacctatttctataaaaacttaaactaaaaattaaaaatgcttagtgtaatagtttgtttcctgccttgtatctctggtggcagccagcacataaagagaataaagaccttggcttgactattaaacatatgaattaaataatcagcatcataatgtttaaaataaatagtcatgtggttacatattatgatgcaagagaagagatatcctgggagttatgttcattgcagttgagacaaataaagtcactgagaagatatgcttcaagaatggagtggaagagtttatctcaattgtactagaaatcaagaaaggctttccatttataaaatagcctattcaaaaccagaattgttctaaaatatgaaacggaatttggttagctgtatatttgaaagcaaaaaggagaatacgtctcaaggaaggtgtctgtgatacattaagaacatggagcaacactagagagtcacttgtacaatgagacaggatcattgtgcaacttgcatgctcactgtctttaggttcagttctctctactgaaaaaatactgtttgagattgtttgatattgatttgctctatctatttttttttttcttgaggcggaatttcactgttgttgcccaggctggagttcaatggcgtgatctccgctcaccacaacctccacctcctgggttcaagcaattctcctgcctcggcctctgaagtagctgggattacaggcatgcgccaccatgccctgctaattttgtatttttagtagagatggcgtttctccgggttggtcaggctggtcttgaactcccgacctcaggtgctccacccgctttggcctcccaaagtgctgggattacaggcgtgagccaccgcacctggcctatctttgtatatgtaatttataaagtgccctaattcattataccctcatgcacgcacacaagtatttgtaaattagcagctaagaattttgtgccatgatgccatcaagaatttatactgcgattatttgtttcttaaggaaactatcgtaacaagtaacatttttatggttagatttaaatgtgctgaatcatgcaaatatataaattatattaaaatttacttaaagaatctttaaaagtatttcactagaaatatgctttatccatattaaactaacaaaagaggcatttcaattgaatttttattttatattatttaataatatttagcatattatgtcatttaaaattttctcaatatgtaaatagttatttgtggaaccatgtacttgtttacataaaattattcttaaagtaaagcaagcgggcattgataagaaatcaagatgctgaataatccttagactaaaactaagaaacaaaaccaatggtatgggaaattgcaagtattgtaatctgtttatgtaagtagtttatattttgaaactactttggttgtatctaattttcccatcctgtgaacttctggattttttagaacaaaccttgttacttagcatttagttttggcagaagtttgtatgttagtcaaatctatttcttaaaaaacctgacatttccatagataaaagctatgaaatctgatagaatggaaaaatttctaatataggtaaatttatttgaacatagtatttatggtgaaagaggttttttttaatttaataatgtttcttgtctattcatgagccattttttgatttctgatttcatttggatatcaatatttctatagcaaatatttattttatgtccatagtataccagacagtgttgtaggccctggggatagaaaagtgaatagagtaaagcctttgcttttatggaacttaaattctagttgaaggaaatagaccaaacacaaacaaataagtacagtcattccttagtatccaaggaggactggtcccgggaccccgaggataccaaaatcagttatgctcaagtccctgatatgaaaaggcatagtgtttgcctgtaacctatgtacatccttctgtatacttaatctctagattacttataataccaaatacagtgtaagtctgtggttgtttgactcttcggatgcagaacccatgaatgcagagggctgactgtatgtggcatggcaaatggtgataaatcctttgaagaaaaataaagggtctggggataggaaatactggaagaatgtgtctagggcattactactttatatacagttatcagagaaagtctcgctggtgaggtaatgtttcagcagaaacctgaagggaatgagggcatcacccatgtagggcaggagcattagaggcagagggaacatatgcggaaccttgaggagaatttttccttatctgctcagagaaggtgggtcaaatccaggggatgagctagaatgttctaaatcagctcttctcaaagttaagcttaagtcagaatcacttgggggcttgttaagcagattgctgggcctcaactccacagtttctaaatcactgggcctggaaagaggcccaagaatttgcatttctaatgagtttacccctgacactgctggtcaggtcaacaactggtctaagcaagtcccattcaccctctgccagtgattggtttagcgtcgtagatgtaatcctatcttggcatgagagatctaaggctacatcttcttagaacgtaggacttcaaagaaatgttttccttcctgatttataaacagagaggtgggaaggacaacccccaactcatcccttttacctaggggcattgttttatcaggatatggtgttcagaaagttgagccatattgtctaaacaaattagccaactcagagccctaacaaccatgaggttctcagatatccattgctggacttccttaattttagatatctgtatttgaaaaaaaaaaagtcattatggaaatcactactagtaggtaatctgttatttgcagcatatagtgtttgaactgatattaagtttttattttcccttaggaattttagtaaaaatagtggctagtttccaatatgtagtgtaaaggttcaggtatttcacaaatgattgcaagaaagcacttaaagttcatgtaacctaatcattaccatgatatttttaaaatagtgaatctctttcttggtgtcagtctaaaataccagaaaacactttgactgccttgccataggtactttggtggaacttatcttcactggcaccagatatagctggaaatcagtaacagacagtatccctagaagccatggaaagaaaaaaattccaaaagctaaggtatacatgtgggcattcatttttcatttgtttgataaacctaaagttgatgtataattactaaagattcatatagtctggagtttacctcttcattttgtatgtttatatcctgggaatgtctaagtcagattattatttactcagaatattacttatggtaagcaatgatgatataagtccttcctcactccctctaaaaatctttgacttcagtgctagcttgcactttaaacatgtattccaatattaagaaacaatcacttgttacaaaagagtagaagtacatgcaagattttatccaaaatccaaatgcataagacataccagcactgatcatgttttgtctaatttctccattcttctttcttttgtggtctattcactaattacttgatgaagaatttgtttttttaaaagcattttcttcataatcttaattttgtctgatgctgcctttgtcaaatctttcattggtgcccttttctctgtgcagatggatgaaatgcttttgtaagtgacagacattcaaaaataacaaacatgagaagaaaaagaacagtttatctgtcaagaagttacagtaaaactgtggaagctccatttggttgtactccatgcgtttagaaactttttgactgaattcatttccattagagtcaccactggtgaacttgaacaactccacaatctccactcttaaattgcactcttgtgtttcatccctcacagaatttacaaaagtggagggtggtttaaaagcaagggtttaaaaaaatctatatttaaatgggcttcagggcctgaaatcctagtcttaatttcttaaattgtactaagatgttttatttttagtctgctgcacgttgaaggaaataggaaaacattagcaataaattttcagatacttttttaccacttttttttaaagggatggaagttaggatcaactgtggtagattcgcctagccattcagaaactttgggcagggatgtggcttttcttggtccctaggatggaattagcctggggaaagctgctagcccttctgaaaacttgtaatcagtgagcagaattttgtagtttttcctctgagtgcctgagcactcttgctgataatcacactcttttctcctgcaagggagcaagtgtgtatcattcttcctgcctgttggatctatgcacaagttgtcaaaaattaatctgatttaaggtttttcttttcctgaactcagaagggaggaaattacagaaaagtatattagtaatagagtaatagactatagcctgagggaaatgaaagcatatctaagcgaagccaagccaggaacaagtacaattttaatgaaaaatcaatgtttcatgacttagaactgacttttgttaggcactaatatttcctgcttttctgtcaacatccttatcattataaattcttttttgtttcaatataaaggtactaaaaaattaacagctaatagattattttcaacctgtttgcaaggctaaagtctctctttgcctttgaaaaactggagtagaataaaaatgttatattaccacaatggatttaaaggctaacgagtggtcaaattgttaattattcagaaatttcttattgaaatgaagaactgtctggatggactggactgtaaagttcatgagggtatgggtatcaacctccttataattgtgtgtgcctgatatttaaaagatatgtattaatctctttggaatggctgaattaattaatattgttattcagaatattatttagtacaataattcataattattcttttcaatgccctgaagatgtatcagtgttttttcctgccatattttaattttattgacataatttagaaacaatgtggagtggtcatttttcttttaatctaatacagaaaaagataaaatgtttatgaatagaagttctgcctttgcttttgctcctgtccccacataccctcttagaatggacaaaatacaggaagaaaacttttacctgagttcttaattttattacatcttacattaattttcacctttttgtgagaaaaataggtttaaaaagtagttgattttttaaccttgcctccacctactagatggagagtattgtcattactgtaaatagaggaaagaaatgatatagaagcccatgacttcaagaagtttatggtccaactcatgacacataaacagatctgaaaaaagtaaagtctaggtaaaatacctcaaaaatgtgtgtgtgtaatataagtatgtatactatacgtaagtattctactaaagagataggaagttttcaagaacagcgatgatgacttgtggaaaatttctgagaagtcattaattctcatctacatcttaagaagtcagctgaactttcaactgggactgggtgtaagcagaggcagaaaagttgtaacagacaggctatatgaggattttccccaacaaatttattcatttattcaacaaaaaattttaaacactccctgtgtaccaggcatgattctagatgacagcattaaaatggtaaacaagacatatcacttcaaggagcttatatttcagatggggaaaccaactatatgtatactatatatatatacacacacacatatatacaaattaagtaatcaagatagttttgaagttttgatacataattcagtgaagaaaaaaagagcagtataatgtgattttgagtgagtttcctgagtaaaactaattttgaaaggatttcggataaatcctcactgagttgatgtttcagctgagacttaaatggaaaaaaaaaaattagcctgtcttataagttgccagaagagcttaccaaggagaaggaacagcagatgcaaaggccttgatgttggaacaaactttagatattcaaggaatagaaaggatcatgaaggcctggtaaaccatggtagagaatttgtgttttaagtgtgaaggagagccactggagcatataaacagggaatcatgatttgatctgtgcttttaaggatcactctggatactccatggagaagagattgtaagctcctcagagtgtgtttagagcacatactgctacaatggtggctaagactaagggagtggaagtggcatgagagagaaatgggtgtatttaatacttttagatacagatatatagtacttgttgatagattaaatgtaatgtaggaaggaaaataaaatgaagaatgataggtttttggcatgtgcgactaagtggatgagtttgctatttcatttggttttgtgacattgtgcaaaaaataagctctttgaaatctaagtaagttgaaatctatgacttctttcccagataggatgaggattgaaaatgttggatttgatatagtagaaaaatatgttgttattagaaaatagaattatcaaattttccagtttgagttacttagcattatatattccaaatattttcctagtttcttttgtaggcattttagggatttcaaaagcatttgccctacttttgtaataaactatttttaaaattaaaaaacagtgcttaaatacacaaatgtgtcatatacagaatactaaaaaatatggtcccttaaattttgccataaagtttctttattcctgaacagatgtaaaaaaaaagttttcttctaattcttttatatgtataacttgaaattgcaatgttagttactgagatgatagtgtgtaataacattcagattctatatattgataacatgcaaacaaatagtacattaaatagtttctataatatcacatctatctttctcttttttttttgccccttcaagcaacaaaatgcattatttttaaccctatgcaaccatctttcttaacctttggtttcaaatttagaacacttcttttcactgattggctttatagtatgatattggtcataagtgaatttaaacttataaagttattaataaaatagttatactccatttcatatttctttttcaaaatgatttcatactaaaaagtttggaatccttgacctaagtcaatgccctcttcctatggatgagaagactgatgtttattgatgatttgattttctgaggcagtacagacagttgaaagtgtgggaacagaaatcaattccctctacttttttcaatgcaccacatttatttcacactgtccatgtagaatcatcagttaaaatgatcatatatgttcaatccctattttcatatcaacaagaataatatgagtatataattaccagaggtctatcgtaataatttctctaatgtgtttaaagaacaagccagagatttttatttgatagagtatactgatagcatcaaactgaggatgccatttgtttattagggagaattttataatttagagtttttttcaaataatatcaacagtaaagtctaaattacttattgcctttaattctaggaatgtcgcattaagtgactaatgaaacggaaataactactgcccatgtaacttcataaatgcccttcatagacatttatgtcagagcaaagatggcaaaatacttgataatgacattatctccccctcacaacctttattttaatgctgtcaatcaaaactgagccagttaacatttctagagaataatattttatcaaatagataagttatttgtaatcatgataattcttggttggggcctctgtgataggctgaataatgtccccccacaaagatgtctacatctaatccccagatgctgtaaagatgttaatttccttggaaaaagagaatttgcagttgtgattaagttaaggatcttgagatggaaaagttattctgcattttccaggtagatcgagtgtaatcacaagagtgctgatacatgtgaggtagcagaatcaaaggcagagaagggatgtgatgacagaagcaaaagtgggaatggcctgctttgaagaagactggggccatgagccaaggaattcaggcagcctctagaaactggaaaaatcaagaaaacagattatctcccttgagtctgtagaaaaagaaagccctgccaacaccttgattttagtcccataagactcatttatgacttctgatctctcaaatatataaaatataaatttgtgttgttttaacccacaaatttgctataacttgttatagcacttatacctaatgaatacaaattctggcacctgcaagtgtggtcttactgtaattgatatctaaaaacatgaaaatgactttggaatcggacagtgggcagaagcttggaagaattttgaggcatatgatacgcggcctaggttgccttcaacagactgttagaaatacgaatgttaaagtgtgtgtggcaaaggtgcagaagaaaataaaggacatattggaaactggaggagaggggtttcttcttaggtggcagaaatttagctgaattgtgcagttctggggaaagccaaatttataagttatcaatttggatatgaggtaaggtgatttccaagcaatgttgaaggtgtagcctttccagacacacacacaaatgtatattatatatacacacttttataaaactatatatatagctatatatacacagacaacacacaaatgtgtattacatatatatacacttttataaaactatagatatataaaactgtatatctacacatacacagtcacacatatacacacatatatatacatatataatatataatttgttgatattatcatctatatgtagtggcagttcaaacttcactttgattatgaagtagcaaatgctacagaaaagtcttaagtatttttatacttagcaattaaaaacagacctttatattgaatctctacatgaaaaggattacattagttttattgcagtattatggtaatatgatttctgcctcttttttctatatttatccaattgcagggaaaaagtattaaaatccagtttggcctcattgaagcacatttgcagagtgttatagagcattggtttatgactattgccctattatagacaaacaaagtattctttatcctttatcagtgtagtgactgaaattatgaattccattcagtttttaatgaaatgtggattacttcaaagattatctatctgatttaataaatgcattagagtagaaagttaattggatctttcttgaatgaatggtgaccactatgtgtgattcataggagggaaagatagaatatgatattctttgagtttgttttatgtgtttaaaacttttaggttagaaaatcaatttttgtgtgatcggttttctcaaataaattatgtaacccctattgatcttacaaaaatcatggagaaattttaattcattttaaaataaaaatatcttaaattttgtaaaaatgggttattaaaaaatgccatatactgaaacacatgtgtagtttattgtgtttttagtttgcaggcagagaaaatgaattttaccccaaacatcagcatagttctagatttgccacctcctgtttttgacacagatctcaactgagcttctaattttggaatcttgttccagttcttatatttcctattctgtattcaagagctcattctgtattaactggtaaagaggttatcatttctgcttggtttatgtagacactctatattcttcattgtttaacaaaatatagaaattcaggtgcttgcaaatatgatggtagaggtgacaaagtgatactcatcacattttgtatatcgttagtagtggcaggaagagccttacagtatgagtattactaacccttacgtacaaatacagattatcttttcgttaacaatgttactctttctgagagatgttcatgtgagagatgttccatattttcaattcaaacaatcttgtaattgctggctgctgctgttgttcacagcacttggctttgcatctgtgcctcttacaattccagtcttgccctttgtttgaggaaacttcctggttcttgtatacctcctgctttcttgatctatttgctgctgtttcccaggtgaaaacccaactgggctatgcatctgaggtagggatggtttcactgtcctagcacatctttcctctattcaccctgatcaccatcatcttggttttgactcttatttaaaaaaaataaaataaataaaactgctttgtattatgcagctattatttttctgacaagttcagccactgtggagacagtttgaagtaaatgtggctcattgttggtggtctaagaatgtctaaagactagagcaaataagaaaatgttaatagagagaaggaaaacagaggataaaaattgaagttcctaagaagtatgtagctaaaatttcgccttatctaattcaggcattttctcttggctttcccagcacagtacttcttagcgatgataacaacagcaaccactttattaatttgctttttttaaatttagaattcacatcatcatggtaacaacaaccatcccttgaatatgtctttgttagttgcttaatttgctacacctaactcttccaccaggcgctaaatattgggactattggccatccattcagaaagtattatgtgcttcctgtctgtaatgcactaaatcagacattgtgctccaaagaagagggttgtaggagggaaggcatcacacctgtatgcagttactatgcagagcaggcttgggataaaaatagacattggccacatctgtgttaaatcatgagctgtgacccttctcatgacagttccccagctctgctaagacacgttctttggaagaagttgcttcacttttcatttgggtagaatatttacagtccaagtaatagatttcctataatttagaatttactaatacttcctttaaacaagtatatgattatccaaaatgtatataggcttttttgattccagttttataaaacaaatcactaatccaatgttgtgttttaaatagaaactttgctgtatgtaatttcagttggcattcgttatatatttacttaatgtgggcatttcttttcagacttatttatgaacatagaccctatctgtatttctacgtctacctgagtatagaaaaatacactgttttttaaattgttatcctaaaatagtggtctgaagcttgcatttttgaacttaaaatagtgtcttggacttattttcaagtaagaaaatataagtattccatagcatgagtatatgtttaatccttcctatactgatgaccatttagtttattcagatttcttgggattacatgcaatgatgcaattaacatccttggttaagatctttacattctctgttataggataaattcctagaagcaatattgtcaggtcatataatatgtatacattttaaataattacagccaaatcaccctcagaataattatacaaatttacattccaaacaatatgttagaatacctatttctccatatccttatcactactaattagtgccagtctttaaaagtttcgcttatgtgatgggcagatatggttaacattttgtgatgtttcatcataacatgattcagttaatgataacactgcttgttgtaaaattgttgcatgaagaatgaagagacagttgtaaaattgttgcatgaagaatgaagagacaaacgcagttaactgttcaacttgtgtggtgcattttgttgcactttgaaaaatgaaaaaaatcaaacatttaaagtttttttattgatggctgctccttaagaaaagcctggaaatactttagtttgctttggaatgtctttaagtgcatagtggtcctgtcgcatttcctgagctgcagtagattctaaatcatcttgatttaagataggcttttttgtaatcactgacagtctctgatttcagaattctgcagacattgtcattgagtggagcagtatctctagaagttataagaactgtactttttgctcttaataaaaagtaaagtgtgtcaaaataatcaaagtggaagaaagcatatgtaacagccatacaaataaattgagattcattagataagctagttggtagaggcaaatgtgaagaatatttttaaattcactactaagataatttttttaaaaaatgttaacttaaagttgctatttttaaaatttgcataatgctttgaagaatgacagtaagacaaatgtcatcacaatcataaaaaatgtgtataaagtacattagtattttaaatttctcctagaaaaaaaaattgctgcatctcttccaagatatataaccaagttagaaaaaaaagttagataaatatgcgtattaccagttaagttcagtttgacttctgcttaccagatgttttgatagaagtctttttcagtgttcactatgatgcctgtttctcacattgctgtgaaacatctaagctatatatactgttttttgataaataacatatggttttgaaaatcagtgttaaaaccacatgaaaatttttaaagtgaaaaattcagttttactctcaatataataattgttttaaaaatctttaaaaaataatgttaaatttcaccatgatatgtacagctgtctaaggagtctattacagggacaaatagaagaatgttatacattgctcaactcaggattacttccttttttttagttttagaagaattcagttttagatttaaccaaataaccagtaatgtatacatctccctgatctgttgtcatgagcacaaaatttatttactgacatgatgctaagaggttttctgcagatactccaaatctgactgggttttgctccatttttctttcactaatcaagacttcagtgaaataaatacatagtaaaattctaataatgctagacttatttcccaaatgtcttgatgttaagtgaataataaactccagatctgattttgtaaatattattttaagatatgcattcttaaatcttgataggcagatgttctaggaggctccaagagagctcaattgggtaactctctcagaggactgacttgctccatatttgcatcatacttttgtgtggtttcattcacaggcacagttgcccatcgtgcaggatatcattaaatgacctaaattaacttttctgcaggaagtggaggaatctcaggataggagaatccagttttaaatacccctgagacttaaattgattcagtcttaatctgggatgactcaaatgacttagtatataatgtctcttgtttctctaaaagagagtctctcaatgacagaggcctaagtctggagatcaagtatgtagtcctgttgactgagaacaggcagaaaaatctgattaatccaaaggaaaaaggcgagggaggtggcagcacagtgaacagatttgcacccaagcacaactaaaagaatgagttagggagggcggggagcggcggcttgtggctgtaatcccagtactttgggaggccaaggcaggcaaatcacctgaggtcaggagttcaagagcattctggccaacgtggtgaaaccctatctgtactaaagatacaaaaattagctgggcatggtggtgcatgccagtaatcccagctactccagagactgaggcaggaaaatcaattcaacccgggaggcagaggttgcagccgagatcgcaccattgcactccagcctgggtaacaagagcgaagctccatcttaaaaaaaaaaaaggagggaggagacggaaagaaatcagttcgtttattttcaaaatgatcaaggatgaatggtaggttcctttacaatttttgatgtatctatttttttaccaactctttattttctttatttatttcagtattttagtttattaagtacttgcagtgttattaaacatagactgaagaatggaaatatgagtaagatatgtgtattaattttaggacactcacatcgtagtacttgtccatgttcctttttttgcctttttccattgatgaaggttatcttctctcttgctcatggctaataattatcactttttctcttaacaaattattttattgttgttatcatttcttacctacaaagttactattctctgtacaactctgttgctagcaaccatcttacaatttggttatccataagaccaaattttgtctctaaaacatctcctgggtgtagctgctcccatgaagacaatatagctacaatggagtatgaatccatataaaactcagtagtcttattgggctcattctctcacagccctgggagaagccttggttgcctgtgtctctttctcatattttgaggcatgcttatggaacagaggtttcccaaccctattcagaccccaaatataacaactgtttgtaagaccctctgtactatgaaaaagaaaaatccattccattccatttaccaacatacgtaatttcaaaagataaccaaagttacctaactttaatattaaaaagagctaaaggaactaaaacatatgcttattgcctaaactgttgaacacaaccacattagaagacagaaagaatactctgatgtttgccactattctgagaatcaccaaatgcaactactaattatgcagactgtcctgtagatctcaggatgtctatcagccctgccctttcccactaaatattatagagtcttaatctaactgggagacccaagtgtccctacacatttcctagatgcctccagaaggcactatctgctatactgagaaccattgctatagaactttaccttcaatatcacttcttatttgtaatgtctgtccctggtggctctgtagaagattttgctctcaatcttccatgagcaaatagaaacttggaatttttttttctgtttcctaaaatagaatacagatatgtccacacttggaaatatgatatatttttatgagtatatcttcaagtggcagatcataaggtgaaatcccaacttgccttatattgtatcattaccatgttgtcgttttgtgtccagatgacattggcagtaagcagcgaaggattcagtaatgttttgataaaaagagcattaatgtaattatttatttatttatttattttgagacagagtttcactcttgtcacccaggctggagtgcagtggcacaatctcagctcactgcaacctctgcctcccagtttcaagcgattctcccacctcagcctcccaagtagctgagattacaggcacttgctacaacgcctggataattttgtattttttgtagagccgggatttcaacatgttggccaggctggtcttgaactcctgacctcaagtgatctgcccgcctcggcctctcaaagggctgccaggcttgagccaccgtgcccagccaatgtaattgtttttaatctgcatcatcttttgaataaaaagacattttaaatatcagaaaatgaccactgtctaaattttctttaaccagcataaatggatgtaaactaagtagtttgcaaattttcatgtctgtttcacttttatctttctccttggtaatatgttttctgacattgctgtgaaacatttcatattacttaaaatgtgtatctttaacagatttttcacttttcagtttaaacatttcacacaatccacacgtatttattaaggacttatatacttgacataacaccaattgatgtttcagtcatcaaatcttgaacacctacttctgattgtctaacccttctttttcaaattaacaacaaaacaaaccaaaacaactgtctcatacaactactccattctccaaagagaagttgtaaattataaaactttaacagtcttattttttctttgatggcctacttaataaatctaaagggactataggtttacaaccttggagtgttgcttttgatttttttccccctgtatcagtccctaaaccaaaacatttacagtactgtgtatatttaataattttgtactgactgcatgaagatataaatgtgtgaatgaatacagcttgttaaacatgcaagtatatttcttcaaagaagagtttacggattctttttccttagcaaagggaagttgtattaaacattgtggtggttgaaatgctgctaatcaaaaattggtcatcgatttgaatacatcttatagcttttctatcatgttgttggtttatttctgaaaacacaagggagaagttgattgggctgccttagctgcctttttctatggtgacaggtgtttagactttaatccctctaactgtgcacatagatgtttctggtgaaaagaatgtactgccctttgtataaaaaacataataatgataataatgtaagtttgagaacggtttagtctacacagttattgacaagaggtacagcttgtactggaggaccagtctggattcaagaagatggtcctaagtgtaccgaagtatatcttttcgtatgaagatataaagaatagaaatatgagtggtatttgaggtgtccgcatcctctttggcactcagaggactctaatcaaacccaatgttgtgtactgaactattcctgacttgtgaaattcatcttttatcccctactttaactttttttttttgagacaaggtctcattctgttacccaggctagagtgttatagctaactacagcttccacctgggcccaagaaatactcccccctcagtctctcaggtagctggaaccacagacacaagccatcacactcagctaattaaacaattttattttttgtagaaactagatctctctacgtagcccaggctgatctcaaactcctgggctcaagcaatcctctcaccctggcctctcaaagtgctgggatcacaggcatgcaccactgtgctcagctaccccaattttaccttttaaacacaaaagctttcattaaatgtaaagccaccatttcctttgactttcaaatccatgtatcagtaaaataaaacaaaaatttatttgaatgcaataatagcagacatatgctgttctaaaatcctcagaaatctggcagtggaaactgtgaagatagttatgatctcatgaagtttgaatatagtcctaaactctttggaatgagagatttgtcagctggattttcatgctctaaatctgacttcaataactttcactttctgccaagatgtatccattatacctcagtatctcctgatattctccaataaaatccactgtcaaattaaaagcttagttctgtcgtttgtgccaggccccaagtgctacccttatattccaaaatcagtagcgctttttccaagttattactcagggagtataaccaactagaaaaaaatttagaaatactagaagcatgttctcctagatttcctacatctatccctaccaacttcccaaagagccctgtagtatcttcacctaccttcctatcagctattcagacataaaaacagctgctttcttcctgggaagatcacgtaatttagaactggcttggggtgtacctctgggttaccaaaaatgattttttaaaaatatctgtcattcaagaaaataagatctggggtcaggtccaggcaatattgtcctgagggtgcttttcttcttctcgtggctgatattcccgcagtgacatatgatataatatgcactaagctgatactgcttcagtaaccatgtctgtgtctgtgacaggtgctactgactcctttcttcatgttattgatctaaaatattttttaaaatgtagaatctacaaaaccctggaggcctttcatccttggaagctggaattattgcatcttttcatccttcttaaagaggggaatgttttcacccttacagttaagttgacagttcatatgcgatgtttacttgactttttatatctggttacaataaatgtataggctgttaacacataataaataatgactcatatatttgatttaaaatttcctggattatctataatcagaatttagaatttctctcctagaagtgtggcgagctgaagctattagagctgtggcctttacaatcctttaacggaataacccatctcctgttgctgatctgaaccgcataactggctaaactagtgcaggcagcatgattcttcacacacaaccagatgccagaaagaagaaaaccacaaaggggctgaaaaacacagcatagagcccagaagcaagagggtaaggtggggcagaaaccaaccagcagtgattggaagggaagattaagtcaggaggcagggctcaaagggcatctgaaggtgagaggcagcagcccgaggatgcctcaggagtctgcgttgtacaagaagctggacattagagataggtcgcaggtcaaaatcagatagaattttgcgatcagagcagacacagcaaaccagaagcacttgaactgttcaaatagcaccttctttccacagcaagtccttgctgttgtgactgcgaatacactggtccactgaagcctgtgacacttgcaatttgggagcttatcacagccggaggaccctgacacagggtgagggtgcaggaaagacaggacatgagattgaggatgctgactcagacaggtcactggaccgttccagtgtttttcttacagggaaagagtgtaggaggcagtgcatctctttgtctttgtcacttaacttttggtgttctttaaactgttctaaattagttcaagatctacaaattgaaggctaaagaagggaggataaataaagcccagcccaagcagttttgattgtagaaacatttggaagtatttgggttgttaggggaaaggagcatagctgattttttttaaattgatttggagtttggttatttgtcatttactcattagttactttcctccccaacaataacaacaaaagataattaccatagtctgttcttacatgaaacactgagaaattttatgtagacattgaaattacttcatcagtttcttctgtgaatgattcatttcacatttcccagtcttatgtaaattactctgcagcatttatatagcattagtgtcatgcaatttgtatcattattgaacatttattttcttttcaaacaaagtgcaaagtgccagaggatgggaagtatatctttagctgcagtttgaaagaaaatgtaccaagcttggtgtcggatgacctgggttctacaaagcagtcgtgtacgtttagccaaatcacctgttcaaatctaggttgcccaaactataaatgcacttgaatgagtgatttttcaagaatgtggggcaaaatgaagtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaatgctatggttcaatcatgcaatactcagatgttcgtaaccatttccatgtgaaaagtttagtataggctgtagagaatgacattttagacttttgaggggaattatttttatgtcagcttgaaattcttcttgaacttgatttctgacttgggggaaaaaaagcaagcctgatgtgcacaagctttatacagagaatcaactgtttttaaaagaataatccagctgctatctgatcagccaggtaggagttgttctgtggaaatgaagaagccctccattttcagtcagagtcacgcatataaaggctttgataagattaaaataatccaagaatgcaatttcaagatgcacagctagaaacagcaactaagaaatatccatatcttacaggacacagctaagggaagagtcaggttttaaggaccgtctacagataatgtcaggatgtacagataaatatgagcaactgctgattgagctagaaacactgctggttaagttataaatcttatgatttttacccttcaaaatgcctctttccttgctgctttatatttttttaaagagcggagtatgttgtcacttggaggttgtgctgctttcctgtgactttagtcacctttggtgccctggccagatcccttttaccaagcctgtaaaatgcccagtttccgtcagtgttagctgctattggctcacagcccccacttctcttcagaatcacttgtagctgaaaaacatttactttgccaaaccttatgtgcccatctcccagcactatcagctcatatctgatgactaactgacatggggaatacaaaaagccagtgccctcacttcattaggtcaactctggggcaattcatgctctagtgctccccgtgacatcaggctgaagttagacttatgctaataccacattctcacttagctgctttccctttcctaccctactttcctctctccttttcatctgacaacactcccttaataaatcatgtgcatccaaatccttgtcttaggctctgcttctagggaacctaagcagtgatatttttgagagtatagattctttcttcttttatctttcatcctcaatctccagcacatctggatcatgatgctttacaagtattttgaagagtaagcaaagtaagaaatttggccttcatttggtgtgttagttagtccttgcattgctataaagtaatatgtgaggctggattattattattattattattattattattattattattattattattattttgagatggaatctcactctgtcacccaggctggagtgcattggcactacaacctctgcttcttaggttcaagtgatttttctgcctcgcctccccagtagctcggattacaggtgcccgccaccctgtccagctaatttttgtatttttagtagtgatcgggtttcaccatgttagccaagctggtcttgaactcaaatgatccacctgcctcagcctcccagagtgctgggattacaggtgtgagccactgcatgcagtcagagactgggtagtttataaagagaagaggtttaaatggttcatggttctgcaggctgtagaggaagcgtagtgctggcatctgcttctggtgagggcctcagggagcttacaatcatggcagaaggtgaaggggaaccatgtatcacttggcaagagagggagacaggagagggaaggtccacactctttaaacaaccagatctcacaagaacactcattactgtgaggatggcaccaaggcattcgtgagagagccaacccccaaaaccaaaaacctcccaccaagtcccatctccagcattggggaatacatctcagcatgagatttggagggcacaaacacccaaactgtatcagttgatcaagaactgaccatggaagatggatagttgaagtcacaagcagtccagcacaattctaaccttaccatgaatctgaattcttagctcactaaagatttaggaacagaattggggagtagaattatggtcatgtaaaaatagagtccgtttaacatcctaaccttaaatcagaaaccatcaaagcatcatatcaacaaaaaaattgttttcacttatgaaaaatatgaatattaacacaattttgttgcacacttactctctgccatatgtcttacactaggcattgagaaaatactaaaaatacataggatatgttccatgctctcaagaagttgtgaattgtgaaagaacctgatagttgaagtaataatttcatgcagtgtgcctaaacatgaaatagaattccatacaaagtgacatttaaataggtagaaaaaccagagaccatatccacactggtaacagcatgggcagaggtttgcagttagacatgaaagttaatgcagtgttcaagaatatactgaggagttagtaagaaattaggctaaaatgtatgttgatacagatatgagaaagggctgtaagactcaagattcactttatcttgagggcagggtggcagctatcaacagtgctaaagcactttctcttccactttaaaaattaaaacagtgtggtaaccttaaaaggtgttctgaaacaatattctaagcaactgttatcacttttgctttttccttttttttatcaggtgcttacttaaacatttctcataattgcaaagattgtgacttgtaattatttgtagttactattttaccatgagctttacccacatttttatgtgttttaattttaagtggctaaatattattataaatagtgtgtgcagtataatttatattcgtcattttcattttccctgaaatctttgtaggctattaagaagaacaatgataggatcatatttaagttttagaaaaatgacaccttaaaagctgcaggtagattaggatgagtaggacttggagtcagaaacttcaataagggagtggctgcaatatagactaggaaagaggtgataccaacctgtcagtgtcctcatcggtaaaagaagatacagctgggcacagtggcttatgcctgtaatcccagcactctgggaggccaaggtgggcggatcacttgaggccaggagtacgcaccaacttggccaacagagtgaaaccccgtctctactaaaaacaaaaattagtcaggcacagtggcacacgcctgtagtcccagctactcgggtggctgaggtaggagaattgcttgaacccaggagaaggttgcagtaacctgagatggctccactgcactccagactcggtgacagagcaagactctgtctcaaaggaaaaaaaaaacatacaacaagcctcataagtgcttgtgaaagctaattgaaataatatattaaaagagtttggcatttagaaagctctgaaacgatcattcatttaacagaggaagctatgaacattttttttttaaaggtcagtttgacttttaggcacctgatttcctgaaggactctttgaactctttgaatgtgggtactgttttatgcattttcatgtgataactaaacagcctgatttacattcttgcccaatatacgtatttcttcaaataatgaactaatgaattcccgggcaataaataccttttggttaaatggacaaacagttctgttcagtgggaaacatgctagtagagtctgcttttaaaggaattgctgtatgcagtattctaagaaataatgaggaagtatttttacttcaaaatactttgatcataatatgatgataggtattttcttctcttgcctgtgaaagtgtgtgttaggtatgtacattatggggccaaactagtgattgttgctaattaggatatatgtggcgcattctatcaagaatcccagttttctgggcactgtgagctgtaagtcaagtcataaaaaggagtgaattgtctttttcatatatagcactgaaattgactggagttaattatttaatgcctacctcccctactagactacaggctgtgtcacacacctccctcagcatctagcacagcaaatggatttagtaatatttattgaatagattaagaaatacagagtgaataaaataggacactggttggagtgttgggtcaaccacaattttggtgtgatatattctacatatcacagtgagaaggaaaatgatataaaatgaataatatcctccttaaagtactatacaaaaagaatacttcttatattttttcaagatgatgtaatcttgtcaaatatataatatgttgcatgccagtgctttcttaatccttaatagtaataccagtaattgtatattaagttcctgctatgtgtcaaatacttctaggtactttaaatgtatattcagtaatcttcagaacaagcctagagagcagaatttagttatttcattgtaaagatgagaaaagtgggtctcaaaaaaagcagataacttgtcccagatcacacagtagtttttcttggtacctggagtgattttcatccctctttcaaatacaaccctttggctattgggaagtagctattacaactgtattttttctttaacttgatgtaagggaaagaccactttacacatatacaaataggagaaagttttgccagaccttctgcagctagtatttacatgagtgagtagagaattgtaagaggttctggtagcagtaaaaacaaattacaaacaacggaacatgaagagaagatgttgtctaccaacatctgtcaaatatggcagatgatcttctttgtcttattttgttcaataccactcaatatcatcacttaggcctctctctcttactgtttagatctcttgggattctcttaattttttaaagcctataccttgaaaaattctgtttaaaaatacattggaaagcatatagattttagtaggctgaataatggctactggaagataccaggtcctaatcccaataagctgtaaatgttatcttttagggaaaagcggtctttgcaaatgtgattaagtaaaggatcttgacaaggtagattatactggattaacagtgtgggccctaaatccagttacatgtattcttataagagcaaagcagaggaagatttgacagaggagaagtcaatgtgaccacagaggtagagactggagtcatgtaaccccaagtcaaggaatgccagcagcactggtagctggaaaaggcaaggaatgagttctcttctagagcctcagcagcgagggtaaccctactgacaccttgattttggcccagtgatactgctttggggccctctagttcccagaactgtaagagaataaatatgtgtggtttttagccatcaagtgtgtggcagttttctgcagtggccttgagaaactaatacagacatagaaaattattttatgactttttcttttagatgcagttgttaagtcagcatttgatcttatttgagctagatagaaccagggttttctaatctacaaactattgattttcatcttgatttaaatgtgtttacttattcttcctctataaggtaggacaattttgcaaaagatgtataagaatgtgtgtctcctttcaggttcagctgaaataatcttcatataacaaaagttagagaaaacaatctgtctgagccagagacttcgttatatgaattcatacaaactaatgaaggaatacaaaacttggcctcacagggagagagtggagtgtcttatgcaaatctttgttgtcagccacattcctacatgcagaatgcaaaaaccatgtttcagtttgttgaggatttggaaatagcttgagataatcttaatttaaaaggactggcaaattctttcagctttgtagaatttattccacatatgtcaaagacaaacttgttgtactgcaaaataaactagtactgtgtgatcttagttgaaaaggtaaatattacaatttacattctattctctcatattcattcttttggtacatgttaataaattgcaaaactatattgctgaaaaatctaatgatcctgaaaaatctaatgataaattctagcaattatcagtgattacaatataggcctggtttgttgttgttgttgtttttgtttttgaaaaggaatcttgctctgttactcaggctggagtgcagtgccacgatctcggctcactgcaacctctgcctcccaggaggttgcaattctcctgtctcagcctcccaggtagctgggattataggtgcctgccaccatgcccagctaattttttgtatttttagtagagatggggtttcaccatgttggccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgatagaataagatttgtccagatgtttacagagctcttacaaggaattattttagtctgtttctaaattattttagtgtgttcatctgggttgaaatgttatgtgcttaaaggattgagttactgtgatgacttggaatatttaagtagctttgaattgtgcgggtatgttaaatgcctgtttgggaaagaaaaataatatgagtgaacagagattaaaatttgtgaattatctgattgccctagagatgtctctatttgagtttaaaataagagattggcctggtgtggtggctcatgcctgtaatcccagcactttgggaggccaaggcaggcagattgcttgaacccaggagttcaagacaaacctggacaacatggaggcacctcacctctaccaaaaaaaaaaaaaagaaagaaagaaaacattagccaggcatagtggcatgtccctatagtcccagctactccagaggctaagctgggaggatcgcttgagcccaggtgggtgaggctgcactgagccaagatagctccattgcactctagccctggagacagagtgagaccctgtctcaaaaaaataaaataaaataagagatcgaatagttctgttttaaaatagtctaggtgagaaatgatagtttggttttttttgttttaatcatattgtttaaaagaatacttcccagcagagttttattgggaaaccacaccaaaataaggaacatgctgggggcaaattcagtggtgaacataaatctgaatgttaagaagacaaaggaggcaacaccagctccagggcagaaggagagttgagaaagttaggaggggctgacactaccaatctagcatccagagaggtttgatgaagaaaatttgactttagggagttgtgaatttaagatcagaagtgatttatgcgtagaaaatgatttctgtcatttcacctgattcttgtaacttcagcttgaagtttctaatttcaagaaaattagaaatcactcgtcagctaagatttggggaaaactgttaatagtcacatgtgatgttattaacaatttattggatagctttatcgatcctgtttctcaaattatacttggttttacagattttagcctttggtttgactcttcttttgccccatttttcttggctgctccagctccactgctgagttcactacaggtcagagaactgttcagtatttttaaagcagaaaatgcggtgaggatgggattttgtaatgtaagtttttaatctccgtatctgagcattttggttcgtgcagtgatcccaagtagctgagatgaggcaggctccagtatcttaacctactaagtatgtgtaaacttgatagagaacacaattttcctttaaatatcttagctctctagtctctcaaattgtgaaaacatattgggggcagattgtgaaagaaatatgttcataaaatataaattcagtgatatccatggaaagagcaaactcagagtgaggcagatggaagaggaataacttggatcatccaggtgggttaggtgttccaggaaatactgaggacccccagccagctgtttgatctggcaatactggaggacggtgcctcagcgatcccttcaaaatcaatgaagatttttcctttactccgtaagctgggggtcattgacagtagttggactcatttggagtgaggtgcatagaaactggcttttaggaattcaaaactctcatggaatatgtgaaccacttggattcagtggatttgaaaataatcgaaaaagtaaatatactaaaggtcaaggaaaaatgaagtcacttgcttaaaggctgctgagtattagattttaagagaagaaacgtaagggaccaaaagttttcatggcaaaaagacaaaacaagcacccctctgtcccccgaccttccagccccgctaccaacacacgcagtgttttatgaagtggtcgcaggagaatctgaagcagccataaagaagaaaggagtatgagagatccaactgtgccactaacaggcacttaatttcttctgagaactaatttataccaactactctagcttttcaaatagcaagcaaaagccaatttgcatttacattgtaaaactctgttttccaaacagtggcgtacagagtgttggtggtcaaatctctaatgtaagcgagggatttggggatcaaatatttcctgaattgttactctttgctagagagtcaagataggcgctggtatgtaccctccaagaagaaataaatggaaaacacacacaggaaacaaacctttataagctttcttcaacattatctcatataattcttagaatatatataaaagaatattactactacattttatagacaaagaaactgagattcaagttatgtaacttccccaactctatacattggtgaatggtcacttcagaaagccttgctccttctaaaactccagcctacctctattaggctgtgatttaaagttcaaatgagaaacacagccaacaagtgcagagaaattccgaagtcccttgggggattgagggctggaaaaggctttgtggaagagatgaaactttctttctttttttttgagacggagtctcgctctgatacccaggctggagtgcagtggcacaatctccgctcactgcaagctccgcctcccgggttcacaccattctcctgcctcagcctccctcccgagtagctgggactacaggcgcccaccaccacgcccggctaattttttgtatttttagtagagacagggtttcaccgtgttagccaggatggtctccatctcctgacctcgtgatccaccagcctcggcctcccagagtgctgggattacaggcgtgagccactgcgcccggctgaagagatgaaactttcttatcaaaagggtccaatttagacaagggaagatgttgagtataaaaaggttgattatctagaattggacaatctatagcccactgaagtattttgggtgtgtttgttagatactttgagaattagaaattgtgaaatgtagttattagaaaattttagacagccaagaaccatttaaaaataaggctcccatcttttcattcattcactcaaggccaaaaaatattttaggattaaaaaccaatctcaaactctaaaatatttattaataatttagactttatactaaattatcttggaaaagctagagctcaactaaaatcattttttaaatctggttcatctgtttaatattaaggcagtctctaatttagtaaataaacacctctaaaaattgtagtgcaacctctattaacgtgatttaaaccatgttgtgtattctcctgagatatgccagattaaggaattatcgaagccttggtggaaaatgacctactcaaaatgaaaatggaattcataactaaaagcatcccaaaaaacagctagtcttaacccttcatttcgtaaataagcagagtgggaataggtttaaaatgtcgaccatctttactattttagatcacatcacgttcttataatttgagcactagtaaaggttttatttgttttctatttctttctctaatattcaaatgtgattttgttcctgtttgtgctttgaatggcatgtttggatgactgtcccagatctggcattctgagattgtaccactaaaaatgtcaagtgcatttgccttttaattacatacagtacctggattttaatattttagatttttccctgaagaagagacttttctggtcctgtagtttgtgggagggaaaaaaatatcactgacattatcatgaagctttttcccccaacgtctccatatatccacatttatcatttcagaacaatttcattttgggtcaggtttagttgttctgtagcttactttgctataaacactatgtttaaatatataattccgcactgtttgtttgtacttctttctcttatttcccattaatgttcagctcagcttgttttactcttaataggccattactacttggatgtcacatatgtaataatcagtatgtggaaggtatagtttcttgtgatttacactcctttccttcctttacctttggcataaatgtgaaccagctcattactttccagggtatttctttttttacttccccaaattaaattttaatttcatcctattgttattctctgatttttattatttcaggtgggcaaaaaagtcttatttgtcaatgaaacaactccataaccactgaactcccttttgcacctactacatagacaaggtacttaaagcatttttgcttttgagatgatacagttcctcaacttaaaaaaacccacaccatctacctccgtgtcttcttcagaaaggtcttctctcagctccaaatctaacacagtcaccaaggcactccaccttgtccttctattttaattctcagtatggaagtcctcactatcaggtgatccttgtttacttgtctattgtttactagacaacacagggatgtaaactgcacgagagtggagatattctctgttttgttcagtgatgattcttcaaaccctagaagtgtgccaggtacatgccagggacaacaaataattcatttaattaatgaaaggaaggaaacaaaaaagtaaatgttttctttgtgtgtttaagatggggcatggaacatgtattttttttttttctttttgcttctaaggcttcctctcagaaccctcccagattccattcatttgtctatccatttaagtctgcttttatttgtccccaaaagaatgtgactgactgccaatttatgtgtatttatatctccccagcttttcctttctttttgttaggtagtagttgaggttgacacctctattgtatcccccacctcacccccatgttttgaaaaggcagtgttaaacattactcctaatataggcagcttaatcacatttctcccaagtgaaagtgccagatgggagtcagaaagcataggctatatttttaattatgtcagaagttaatactagaactattaaaaagccactttcctctcctgagattgtctttctttatttgaaaactggagttggactttttttgttgaatgattctaagaaatgttttagattgtcaagaaatcagatacaaattcatccccctgtggaggagccctatctgtgcctcttctgtaataccagtagccatggtatgtattgcagtatgatgctaataagtacagtcatttgagtacttaccatattcttcttctagtttatacgctctctaaaggaagaacacttgttcatctttctggttttttagcctagtacaatgttttgtacccatcagataattcaacaaatacgtactaaatgataaacaataacagattcttatctctgttttttttagaaagtagacttccctccatctaatgctgcttctgtgatgctataatatttatggtgcagaaatctagatttagaaagagaactttattcgaatctgtttatacattccctaatacttactgaggctttatgaagtaccagatattgtccttagcactttacatgtttcaatacatttaatctttgagtcaatctagaaggtagactcaatctccattttaccaataagaagtgaggagcagtggttaacttacctaaggtcaacttgtggcaaagctggaattcaaactctgattaatggttttgttttatcaaaaaaaaaaaaaattaaggccacctgacaagaatgttcactattagtgtttttccagagatgttgaagctctttaccaactgatgctatgaaaagcagaatttttctcttaaagaatgttttagattttataaattagttcagttaaccctagcattaatgtatttgtttcaaaaaaagtttaaaactttaagcagtatattatagttgataaatgctcttatataagtagcataccttgacaaattatgagcatttttaatatgttacctattcattgggcaaatatatattaaaagtttataatgtattggtaactatgtaaaaatcattagccataaagacatgaatgagattatatctttgcccttgattcgctccagacctagtgtgagttgtagacttgctgagaaatatttgcaatacaatttttatttgggttatgggaaaatgattaactggtatttagaggtgagagggtagttaagggaaaggtgttaggaacactaaagaacataaaagcccatgatcccacttcccattttggaagcctggcaaattaggttctcagaggacctctgcagaacagtcctaccctggataggacacatctgtggatacattgctggacttacagtggctggtggagatatctcaggactcactattctgccaaatatatatatatatatatatatatatatatacacatatatatttatttatatatgtataaatatttatatatgtatatatatttatttatatattatatatatagagagagagagagagaaggagagagagagagagtgagagcgagctgaaaacagtgagcaacaggcagaaagagaggttggtaatacctgaagggggatgctaaaactatattgcccttgagacttttatcttcagactggtaataagagtgttgcctagcctgggactcccatatggagctggcagaggtggtctgaggtctgagacacctcatagctactggtaggagatgtaaattatctttgagatgaaagcatgatcaatttaggcctgcagggttcccacaggctaacataaagcaattaactcacaatcaaaggtcaccaagcattcttgaaagtaactcactttcaagagtgagagttagcagaaacaacagatgtaaatcctcaaaaaaactgcaggtattgggattgtcaaatacaaatagccttgtacaaaatctctaaagaaataaagtgcaaatcataaagattaacaagatgctatcaggaataactaaacaaagatccgtttacgaagaaccaaatggaacttgtaggaagggaaagcataattgttcaaatttaaaaataactctttggatggacttagtagcagatttggcaaaatgaagagataatttattagctagaatttaaatctgaagaagttacccagaacaaaacataaaaaagagctaagatgctcaagaagaaaagaactaggcctgggaatatctccataatatatacaatatgttacagaactatagtagttgaaatcatttactgtcagcacagaataatatgtttcctctaagaataaaatggaaaatccagaaagtgactcatgtacttaacgtaattttgatataggacagaagtggctgtgtagatcattggatcaattcaaaagttatgcacaggtaactggatatgtatgtggggacggaggaggacctgaaacaactttctactatacatcttggactcttttaaaactttcaaataaaaaagaggatttttgaaaaactcagctttgaaggagcttcttaaacaataggccctaaccataaaaaaaaagattgatatatttgacttcattaaaattaataactgttattcataccataagtaaagtaagaagaaaagcaactgatggctttcagggcacattaccccaaaatatggcaccttggcatactgaatattttaacctgaaaaaagttggagaaagtgacaaaaacaggaagatctctctgaccttcccttgaagcagatcataagaccctcatatgagaagtgtcctccttatagctaggggggaaaataaaaagcacctttctttccgaagataagggacacatagaagaatctgaacaaacaggccttgctaagttttctgcagtttactatacttagctcatactcttcgccctatcatagtcctttataacgtcacccttcatcaaacctgctataaaaacactcgggtttaactgttgcattagttcttcatttccttatgaagtctaccatgacttgtaaaacttatattaataaatttgtatttttctcttcttaatctgtcttttgtaataggggtcctagccatgaacttttaacatcttgaaaggatggttttcatcccttatacagtctgataggagaagatatttgtaatacaaatttcagtcaaagctatatactgagcatttcagagaaaaaaacaggtagagatatttcaggtatctcaaaaggtcattttagtagtaatcaaatatgtattacatttcattttctactactgaagtgacaaaaatcaagaaggctgataatacaaagtggtaagatataatttaaatggggttggcatacgctgctggtgggtatgtaaattggtaatagtttggtattatcttgtaaagctgaatatttacaatctttgttttatcaaaatgggatggataaaactcagggaccacagtttgccaactcctaaaataaagagtatttgagaaatggtgaaaggattttaatgataagagtatatgaatgaaagtgtctcagaagatgaggttgaaaatgttgattggcacctgcttgtgaaaggccgtatgtgtcataacttttgccttttcctcttgaatgtaaagcagtgaagtcatttcttcgcatttaccttttagaaaactcatccaactagtaatatgtaggataaatctgaggtagccaacatgggaagcaggaggactagtgaaaaaacaagattgggtcttgaaggcagtcgaaggtggggtggagaattcagaaccaatttcagagagaactaagcagatagaatcaactgtgtttaagaagtaagacagtgcactaacgctctattttacctaattgaatgaatttagtgggaagcttgatgaaaaattaatatgcacattaaaacatttcttcttcattactatgaaacaaaataatattttactttttttaccattatatacattcctaaaatatacttattttattgctttcttaaaaagtatttctgtcacttcagaattttgtacagcattttgaactgtgtttttaaaaccaaaacaaatttagagactctaagactagaaggagatgccttaagcagtgtaaaattaattttcaatatctgcagtattaatctgtaattttatttcttagttgtttaaagtcttcatagacttttgcactattttccacatcagaaatctttggatcacgtccatatcattattaaaggagaataaattattttccaactactgttaaagcacgtggcatttagctgctctcttttctcaccagtaaaatctctggtagaccctgttttagtcagtgatctaatactgggcaagtttcataagatcacatgcaatgaggaagccaaattacttcaaaagatcattgagttaaataatacatacttcaagacacccataaggtttaggtgtccagtgtggcagcctgtgtaataaataacatgtgctttacaaaacctgtcattgtatatttatataataggcagctaagattttttaaaagctgtttttcagtaatttcatttttcctattcatagtttttcatttctatgtaatggacccaaagaactgacatctagattatctctacctagagcagcagcgtctactactatttctactatcccatgtgttttagtttacaaaaacctttcacaccattatgttacttggtattcctaaaagctacacaagatgggtaatgttattaattttttttatagatgaaggcattcactctaaaagattctcacttgctcattgtcacacaacagataagagaacaaactaagaatcaaaacagggtcttgctgatccaatcccttgtgctttcagtgacactggacttttcttgcacattggtttggtgataggtggtgacagatggtggaaatggttagctctataaaggaatgtaacaaaggggcttgaaatttccagagacaactcagaaatgtttgttatcaagttcatcttatgttaatgtccacaacagtaagagatatgtctgatcagagacatccttgtgttttttaaggagataactgattttctatatgccagtgcaacctagcttaggcaggcttagtggtggtctttcatttattcaactaatattttctgttctgttgctcctttttaggtcctactagaaattcaatggtgagcaaaataaatatggtttttgctttcatgggctttaccttaacagcaatgggaagctattggagggctctaatcagtgaagtgatatgatacagttgaaatcctagaaaataccgtgtgctacaatgtgggttttgaggtggaacaggcagacagtatattcagagatttaacataggtggctgctgtgtgatctgcctgagaggatactgatctgaatgaaggtagtagcagtggggatgggaaaagtgatgacaaagaatatttaggaagtagtaattttgtaactaattgtgtgagaaagtgactgtgcattccagtttgcccaagataattccagtttttgttttccttcaaaagcatcccaatttggatgataaatgttaatcctagagataaggaaagtggaggattcaagaatgatgcataggtttctggcttgaagaactgtatggatagttttgccatttactgaaaggggatacactagaaaaagaactggcatgagataagattatgagttcgggttggacatggtgtgcttaaggtgactgtcatacattgacgtgaagacatattaatcacatgactccatgggtcaggaattcgggttgcaacttttggtcagagatatatcgattagagagtgatcagttatcaggatggtaactaaagagatgaaaatggataagatcaccaagccagaaagtatggaacacagtgtcaagaggcataggtccctgaggaactcaaaggggcacctatttttaagggatgagcaaacaaaaatctggaaaggagagaccagagtcctcagaaaactaggaggtacccaagttcatggaagtcccaggaaaagggtgttccaagaaagagggagtagacaggaatgtcacatgctattaagaggtcacataaaataagactagaaaagtacacattgaattcagaaacttgcaagtcattagaaacattggttatggtggtttggtgtggatgggggacataagcctgccggtaggattttaaagaatgattgggaagtgagtgggaacagtttctcagatctataactgaaaaagaaagaaagcactaatgaaatgccgggaggatttgcagaatttgagtgacaataatgtctctgaagacaccataagattacttaatacattgtacttacaggcttctatctctaatgtccattatgaaagtagaagaattagtttgcctaatcacagctattaagatagttttaattttttaggtaaatttgtgtgactttaaagctatttcatttttaagtagtgggagcaaggacacaattgatcaagtcactttagctatttttaccccccaaaatgcatcctagaaatttgctcaataaaaataaaattgtgccttagttttttttctcgttgtacaaagaattatgcttctcttggcttctgaacactggggattccttatatgctctttggcagataaaaaaaatggtaaagatttatggccaaggaaagcatttctgaaaaaggtgctccacattgtctttgtgtatgtgcagaaattataaacagaactcaggggcaccaccactataatagctttttgctctctttgaagaaaatggaaaatgctgacttaggggctactgcttgtatttcctttaatgaatcttctaagcttgaatgattttaaataggatatttatgttcctcggttatagcaagccaagtacttaaaaaaatacatgtgattaaaatatccaaactaataaatatatacagacatatttagtaaaaactactgttcatagtagtaatagtaatgatagtaataaatgccacagctaaagactttgaggagaattcacagtcaaggaaaacaaccaccaaatcacatgtatttggagaatttgattagacttctatacttaagtttaataattatgttgaagattagtgaacaactcttggcacaagaattgtcttgacagacaggcagccttacccaactcaaataaataacttaatgggcttttttttctttattaaccacttggtaaatgtgaattgaagtctagtttttaacaaagacatatagattatgactttattatctctgatttgcataatagattatgaaagtctcaatgctttgtactcttggtatacctgcaagcgttttagtttctatctatgttaaaaaaattactttcagatttggctttttatttctggaaatatgtttacatgaattcattaacctatctatattacttgtaagatcttaaaaatgtcttcatcccctgagtttgaaattgttttacccatcaccctcatgtcagttctgttattttattactaaacctaggtaatagtattaaagctgctgttcttacttcatgatgatagtttatatttgcacctacatacattatatatattatatttgtacccatatacattatctgcttctggtagggattagcagctctgaagatttttgtaaaatgtagcatatgcgactcataataaaatatatttagaaaattataccataatagcatgtattttatttaattaaactgttatgaaaaatactgacctcattaagcaagaactgctcttccagagaattttcagaaacatttaattctataactcagatatgtcagaaaatcactaagggatcattatcattagcccctgaaagccaagtgtctcatagaacctgaagaaagtagtctttgattagtgaataatgatgatttgttgcatggactaaagctttttttctagagatttctacatcaaacttctgtttctcttcctatttgaagtagtatctgtggcaaaccaatgtaatttgagttacaagcaatgactatgttccttttaggttttttcattcaactttgtaatatattccacctgttttcaatatctacatatatagagatatagatatatgtatatatttctaacgtcgccctggaaaggaaaagatctctaacatatttactacatgttttggtaaattcaaccataaaataatttgaaagccttaaggtatctctgttcataattatgaggttagaaattccctacagccggaatatatggaaagtgtcaagtcagaaagggaatctcccttagtttcccaaaatacaccagccaaagccttgctttttctgcttgagaataatagttagtgaatctagtctatggagaagtttttatgcaattgaaataagataaattaagacagttatagtgaattgttttacaaagttaactgttctgacgcttttatttgagctatgtctttctcaccagtttagctttaaattaccattttatataatgatatttacattagatatatttattctttcagatttcttactttgagaaattaatagttaacctcaacagtctccttttggcagaatctgtggctgttgggaaaagtggagcagatacttggatgtatagaactatgggttgcggggagggggatagagaagccaagaggagaaggtaaagaagaaaggatcagaatgtagacaaatggttgatttttaagagctgattaacagattgtccactggaaaggcatgaggttaggtttagagatttctttgcgtatctgttcatgtggacaccatctcttgactccaagtgcaaggtgctgtgttgggtgcttcaaggcaatttcccaaatgtgtctaatcctgagaatcacctggactcttgttacaccaatttttagcagtaggagccatggatctggagacattgagaaattttgtgttaaaagacagaagatatagtagattttttctttgctcttgagcaatttataaactatccttatctttgtaagcctcagttcctttatcgataaagtgtagataataatactttccttgtcaattttcaaggtaaatgaggtaaaaggaaaatgtcctcagagagttactggggcttgtaaaagggttaaagttggtaattttaattgattgtgtgtatgatgagtagtcagatggttttgagaaagaaaggaagttagggcatacaaagaagtttttaaaaataatcatcttctcaaagttgtttcccaactttattatctgggttttatttaataaaagaatttgaaatattccttggtgtgtctgtttttctttgcctattcttctcttgtgccaactcaactattcatctcaaattatatatattaaatcataaacacatgcttctaacagttatattaggcatttatttaacctaaccccttctgtcccagacaagtaccattaatactgccttaaagcaccaagcataccacctggcatttgagtcaagaagcatttgctgaattgactgataaacctctaaatctgaccccatctctttccaatgtactagttgctagacaaccttatgttcggactttcaaggacacttggggaaaactagttcatcattctctttgatatttattgtggaggtttgttttattttttgtgttaacaaaacctcttgtcagaaagatttccttacctcaaccctaaatctcgtattgtattttagcatgcttctgtatttacattgtgggattatttttattaatatacaataaacaagttgtgtttcttggaggtaattactgggaataatttttttctgtgattattagcttctttcagtaactgatttttttttttatccatttagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggtaaggcctaatattgtcctgtcccactcacttaccatttatgtcactggttttaaaaacctgtttttctcaagatcctttaaattagaacaaacaacaggaagaaaattttaattttaacaatgttgtcagcacctgagtctattggacatgctttctaataaattcttatttggttatttgcagtttaattttggatataaacatatgctttttgttaagttgacctagaaattaatatccgaatttaaatgtctcaaatgcaaaggtacttgagatcatttatcttatatttgaagtgttattattaacaatggcaaaatatggatttattgtgatacttgggctgtggtctaggaattattttgtgctctttttctgtatttttctacttcttggctacaaataagatatgagaagaatataaacattatttagtaaaattgtacattaaatattcattgactaaaaattttagccttttaaaatagagagtaaattgttttaattgaacattaactttttatactatatcaactaatatcaccatcttctgacgttacttgaagatactgagacctactggaatttaaactgagctttgctctggagaccaaagtatattcctgatgaaaagcatttcaaagtacacagtttttataatatgagctattgtacattatataaaatgccataaatctgtaaggcattgtcttggaaactaatatagcactctaatccttcccatcatgtatttgggttaatgctacaatttggaaggacttttaaaaaaaatatttataagcaaaagtacagtcctaaaatagtttggtgtatagaagtggttgtgatcagtgaattctattgaaaaatataataagtgatgttgcttatattacattaaattatctagtttactattatagttattttatacttgaaataaagcattaacattatagataagactcatactacatgttttaatgattccatcagagtttattttaatatattgcctctttacgattatcccctggagatatatatgttggagaagacacatctgcattagaaacattaggtatgcattatagtgttttgtgttaaattagctacatacgtgctttccccaaatagtgctttctcttgctgttgtctccctctgtggttggaaaatacatcatatgtgaggcaaaagttttaagtattttagcaataaaaatttgccagtaaagatcaataaaaatcaccaaatgtaaccttcagaccttatgtctctgtttagtttaaatttgtatttggagacttaagtaaacaatttagagagtaaagttaactaaacattgcttcacaatgttctggtcacttcagattggatgtaaacatgaaagtggcttctgattatatcctcattcagctagaattgggctaaactattcagttttatttgttatttatttgaaaacattcatttgtcttgataactctccctatccaggcctctgatttagcaataatgaaaaaattgaaaaattaacctcctaaagtatgctaaaaccatcactaagcaagattttgggggaaggtaaaatgctctgacagctctctaaaattgtgtaatatgacaacttgattttctggttcatatattaaatggttaagttaatgagcctctctattaaaatatttaacatttgagctttcataattatgctttgattgtcttttgatagaaagtatgctagggcttttgcttctgttcctcaccatcacctttatacccaggaaaagctgcacttttaaagatagaccaggtttcattatttagatatgttaccttctaatatatagtatttatatctacattacttgaatttcttacttaccaaagcaattttgtaatgacttttactcatatgtagcgtgtcacacatgtaccatgtatgctttaatcacaagtatgtttatcatacatataaaaaagtatagatatagcagcattgcattggatattatcatcaagtatagcttaaaactattaatataaaatgtttcccttttaatatataaatttataataaaaataatggaaaaggaaattactttagcctcttatctacattttagtgggaaattgttaagtttgattttatccctcactgggatgaatacatgtagatatatttcttatgcggaaaacagttccatgtctttttggttgttttgcaaaagaatggtgtataattcaattgagtaaagttttacagctaaggatatgtataaagtaagtttttaggctaagaaaagggatattgcatctttcaaaacgcaatgtcattttttaatttaatcgctattcaattatttccaaatgtatgccattttttcattggttgtgtattatattttacatgcacagcatgaacacattaataactcaaacataaatttgaaattatgtttcaatacagtaaatgtttgtgtatgatatcatgttcacatgcatctactgtagaagtatctgtgtatatatagtatatggtatatatgtatattcacataacatatgtatatacctatgtaccattaagatataataacttgtttgtagaaatttaggtgttattctgtatatatgatatattaacataatagatctttatgttttgtatctaaagaaaaataatctatatagtacacaagttctatgcacagctgttccatctgtcatatttagataatggatgatattatgcttaactgcatgttgaaaatacacaatccatttaatttttcaatattttggcaataagaaataccagcatgttattttttccaaattatgtattttaaattttatttttatattgcatatctgtctgtttaattgcatggcaaaaaaaactaacaatgcatgagcaaattgaaatgcaaagcaaaaaaaacatgaattttattttattttattttattttttaacgcacatttttctgctttattgaatgtgacagagtcacgcttttcattcaccattgcttctctttttccactgtctgtgatttgcttgccaggaggagctactattcttactcctactacctgtaagtagaaaatgggtgatgtacaactttacgtgtgttaaggatgcagtatcccttttcaaaaacaaaacagaatgcttgcaattttggtgacatttcaaaaaaaaagttttttcagactctaaaactataaactttatctatcacctattttgccaatctttttaaaaagggatattgtatttctgtatgtccagctacttttaatttagttataatttccataagtagctttagtctagagccaaaaacataatttatttactaaagttaaacctgtaccttatcttagcaatatggcacttcactcatctggtaaatgtctgttttaatttggtggctacagtaaaacagacttgaaaagttagtcatgttatttctaaaaggaactaaaagttgatcaaaagaattaattacccaggagtatcaaaacttggctttagcttgaatatttattgaattactctagtaaggaggtatttattttgcttttaataaatataattatattttatgatatttaagagaacaggaaatgatgagagatttggattgacagcttgaatattgaaatatgcatctgacaaaatacttttatagcaaggagcaaatataattgtttgaatgtcaaacttaattcctgaaattgtgaccagtgcttggggtttctaaaccatgtttgtaacattatcctcgggctcacctggactatttattgctggtgttaactctcctgcaagcctcaaacactaaggatgcccttttgtatttgccttggcagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggagaagcagctagaaagaagagaaagagatggagaatattatggaatttacaagaaggattctcatcaagattgatactggatttagtttaacttcaaactctatgaattttattactgtatcacaagggatattccaaacatataccactcagtccatagcacgtgtcattgctttaagtggaaatacacgattgcctacaaaaagttagttcatgtcagaatttataattctttttccatttgcatcttcctttgtgtaagatgaaagtctcttttgcgataagaggaaacagtaattctttttgggaattattgacataggtaaaatcattgcattaaagtagtatattgtagactcctggaaaattgcaatactaaaaagttaactcagggaaacattagtctacatgctcttaagtatctggtgtgaagtccaaaagtatacttgaattgggggttttgcaaggcatagtgaaattcatccatccatctgtcttgaaaattcctaatgttggtctatgaaggcaaggcttttaaaatatttccgctgaagtaccatttaaaagcagatgattttaataattaccccagaatcaatattactgtttattttcaaatttcatatgaatgttatattctgttctatagtgcatctgtttaagttaattaaatttaagtgaaattgcctaactttgtttcttcaaatcctcaagtaaaactgatgcttgaggcaggcaaatcaggtatatctcttgagtatactggccttgtataacttgggccttatggcatttggctcagatcgcagagatatgctcaccccggtttggaaaacatgggtataagcaaagaaacaatataagtattatctcctgtacaaactatgaacatatgtaatagtaagattgaaaacaaagtatttgtaggttgtatgcttgtatgtaaagagggaagtttttttctgaattgttcagcttggagaaatttttcagtaactattggatctaaaatgaagcccatcattttctatgtatatatgtataccaaattagtagttaaggatgctatacatgagtcattttggaatttagttataatcatgacagggcctttcagatctattttatttttatttcactatagataaatgatagagaaaaatgtaaaatactattactgttgaaagtaagttttgcggaaaataaagatgtatcatctctttaactacttaatttaatatttaatcaattaaggttttgaaagcattcatgcctcccaaacttgtctatctattgcctaccttagggccttatttgaaagtttgaattcagcagtgtaactataaatatccacttatgaacttagagaaaggattaaatctatttcccacagataactgaaaaaaattatttggaatgaatatgagataattatttctttaaataccttacacttgatagatctaaaatacatgggtttttttttctttaattttttaatgtcaagtttaatcttctggctttttaaattaaacagagttctgaaccataattatagatacacctctcttgatgtttagatataacccaagctgagagagaaaattttacatttgcagaatacagtaatctgagaaagtttaataattatatttcttaagaaagcataaatctattttaaagaaaaaagattttaaaaaacaattttagagcaatatattccttcatgagctttgttttcctgcagtgcccaatgatccacttgtaccgactgctgtgttaggtgaggccctaaatctttatcatcttttcattgcatggatcacacctccttgcatgggtttgcccacatagagattatttacagtgcaggaggcagcttgattttgaaaatagacagccatggtattatcaaagagagcaactgtgttcaacccaatatcagatctagtggatttcaaattagcaaggcatgctatttaatgtattcttcaattcttggttgttagatttggagcaaaagtacatggcccttaatgtctgactaatattaatgtgtcaaaattagtagaatgaagccaaatgcatacatctcagggtgcaatgttgcctgaataactagtttatatgtaaaagtctacctaatggaaagggatgtttctaaatcctcccaatttataaccacgaaagaacaaatttacaagtaaatattaggattatgtgcatttgctctagcttttgtctttattaagaatgttttaatgtaggtaaagttgctaaaatcttgatgtggggtttgacattctacatgaaccttacctgataagtaatgttatctttcaagaaatttagaacaagctacttgggttaccactgtataacatctaagacaatgctattactaatgacaattaacgcttttacagatgtaaaattatattaatttttaaacctacctatatatttaagaatggaatgggtttcatttttcatttcactttgtaccctgttccttgactaattatacaccaatgattagtaatcagcttgcctgtatgtttacaggttccatatcaattttaccagcgtttctagttaagctttaaccaaagaaatatggaaactatcaaataaatatatcttgtaaattcccaaatgtcatgtttgttatttatatttaacatttcttgtgaacaaaaaactttaacttatattttatgcttgtatttttgttatacatacaatcaatgttcaattgcatttttaaaatattttggaacaacacaactaactcagttatgtaaaatatacctcttatttactaaaataaatatttaaaattataattttataattactataaaggatatatattctaaaataatctgaaaagtcaatgttcttcatctctacttgcactctccctttgatgtccaccaataatggttaggaagtgaactggggatttgccccagggagtggtcttatcacacagggaggagccataaatcatgatcactggggatcattaaggatacatcagatgcctctgaaaatgtcatcttctgctaagcactgtagaatgctgtcagtataaagttaataaataaatttcaattaaaatattgagaactaattggaaaaaaattagttgcctaaatgttaaaagtttccttacaataattttctacacatatgtaaagtccaagtctcggtcctcctgtggatttacaatatgaactcataaaaataccttacatctttgttttcccatctataaaacagtataataattcctaccatacctttttcatggggttttattataaagagaaaattagatgatgtgtatgagttttataaactgtaataattatcatagtaattttccctgtgaaaaaggatattcatgtttaaggaaagctagatttaacacaatagagtcataaagtctagttatataaacattcattacacattttatttaattttgaaagtcaagctggttttaaaaatatattggcattctttaaaagctaaatatctcattaatcatattagatgtagaaatgatttgttgtatttttcatcattcttaggattgtggtctttagagttttgcatccaatcatttttgtatttataatgcagtttctgaaatcacttcaaatattgcttaatgctaatacttactgatttaaaagggcttagaaacttttcatactgattcgtatttttggtttttgtgttttactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtgaattctgtgtttctcactgagcctttttcaattgtaaatattctgctactccagcaggtaaaagtgagctctggggctgctccactgagccctggctaccttcttccagcttgagtgattgcattttgcctctctgacgttatctgttctctttacttctcatccttaactgtatattctgtggcagtgcccaaatcaattgcttctgaatttaatttttctggggagatgtatttattctttatgtcggtctgttgattgtaatattttaatagaagtagatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggcaaaaatgttcttgttcttttcttccttcttatgacagaaaaagaatttaaagtttcttttctttttaagctaataacacaattgggaagggacttacgcttaattgtgagtggtcagggattcagttgactttttaattcattcattggaatatttattgagttactgttatgcatcaggcactaggaatagaaagaaaaatattctgtctctgtactgggtgttcagaatttagtgaggaaaatagccaagtagataaatcattaaaatatagagcaagtgaaatgacatgtaaaaatgaataagaggtcatgggaacataaagaaggagctttgtaactcaacctggaggggccagaaaagacttccaggggaggaacccacattttgctccagaagcgcgccctgatttctctcgcagcgtggccaagagactcaaaatacatttgcaataaaaacaataacagtaataagtcaaggcggcagaggttgaatataaatgcacgtgtagtctggctagcagacagagtggcatcagggggtgatcatgtggaatgcccatgtttcccagtgcagagtgtgttgtggtaaaaagccccagagaatagggccacgagaacaagaagagcagccctttggggatgggtcacctagatcgggtatctctgagggaggttgggatatggttgggaaggagtttggtcgacttaatagaccatgaaaacacctccacttgacagctgggtcctctggtcccactctatactgctatgactacagatgcaagaaaaacaactcagcaaaatttcccgcttaagcttttaaaaggtctatcagatgtctccctgcatctcacagtgtctgttgtcttgctgatatacacataatatactctcacctgaaaccttgagttttgtctttggggatactgtctaggcctatactgtatgatatttctttcccagaattcctcttgttatcagaaagatcttaaggtcttaaaatcttcattgcatagatacatatattaaacaagataactttgtctcttttttaatcttctgaaatctgaaaaatgccagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgaggtgaataagttttgatactgtattgaatttgatttttaactatgatactcagtggaatttagcatttttttccctctctttaacacaacaaggaggggattgttctataggctctctaatctagtgtttatgagtgtacaaccaagtgtgtgtacctgggaatgggaagggaatggggaaaaaagcacttcccagagatatatgagtctaaatttattacaagaatctttaatgttggattccgtaatttattttactatggtattaaaaaaaaacactttgcgtatctccccatgcaaaaatcaagtagcaatacactttgggtcccattgttccattgcagattctatcatttgaatgaatcaagtagcaggtacttctctgcccctttttttgttgaccttatggttgagaaatcagatgaagctttgtgctctaaatatactacttgccactctcagtttaattttatggattattggttgagggtggctgagaaaaaaaatagagcactgcaaatctagtaaacaacactgagaagccaaaagaaggcagtgggaaattcttcttccaaccttatttccccttcctactcaaaccaaaataccaggacttatctcacaaaggcaatgatttaaaaccaaacattccaacaaacataatatagcaaaaggaaaatagttcctttgccacccttcacttactgagaaataccaatctggggcatggaaggaagccagtccactacccatgaacacatcacagtatgcacacatttaaagtgaaagaatccaagtaatattttgctttgaaaaggccatccaaaatacatccaatttcatgaagaatcttttaaactccatattttatctatggattacctgtataccttaaattaggagtgttaattatctctgaattttgaaagttgattttagatatatgccagaaacactgccgtggtaacaaaataagtacaaggaattagactattctgccagagctggttctttttgttcatttcatgtgtactcctgtgtaccttgcttcaaagaccactgggctctttgaagaccccgtttcctgtgttgagcaaagtttaagttcttttgcaaaatgaaatttacacccgttttaaattgctgcatatagtaattaaactagtcaacaaattcttctgttcccagattcttgaagaaggggactctattttaatttttatatggtcccttgttgtgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaattttaaaatactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgagaaagtggtttttactatttggggcttcagaacagataaacctgatttttaaaaaggaattaaattcagtctgcttattcgttttgttttcccagagcttttttgaaggacagtcagcatcttgggatgtagctaaaaaagatcaaaatagagcaaaaaaccgatatggaaacattatagcatgtaagttcccattcaattcttggtgaatgtaaatattatatgcttatatggttttaaactttaagaaaaatcccagagagtggtgtgtctgtttatgaagtaatctatttaatattaaaacagcatttacaatcaggcttgagggctcatgcctgtaatcccagcactttgggaggccaaggcaggtggatcacctgaggtcaggaggttgagaccagcctggccaacatggcaaaactctatttctactaaaaatacaaaaatcagctggcttggtggcacgcacctgtaatcctggttaatcaggatgctaaggaaagagaattgcttgaacccaggaggttgaggttgcagcgagcagagactgcattactgcactccagcctgggcgacaaagcgagactctgtctcaaaaaacaacaacaacaaacaaaaacaacattggctattagcagtgattctgaaattgtcatcatcctcattaattaaattgactcagccacttcaccctgtggagataacttgctgtttgatttcatgtttgtacataaatgcatggggtattactgaacagctgagactatcaggataatgaaaaagtaagatcttttcagttataaattgttttaacacttccatcaaacatattcaagattggggtgttattctttccacgtgcctttaattcttacttggagccactgtctaaactccagttgttcgatattatttatcgttagggacttcctcctgagtaagtcctcaagatatacacgggataataaagtcattatcagacaaaaccacaggatcagtaaagaaagtagcagatagtttaacttgtaactagctgctgatttacctagaccactctgctctgaatttaaattattttaaagtatcttatgaatagctcaaaatctaaccttgattctcagggagtaagaaactgagagcgggaattcaaaattcactttttaattctgtggctcatttgctgtaaagtgcagaagaaaaggatccaacccgtttaaagtcatgactaaaaagcaaaattagaagttaagtctagttcagttatgtagacaattctatgactcaaatgattacttaccagacaatttcatgtctcctaaacactaactatgaaggttcaagtcagtgaagcttaagtcacacaatattataagtgtaatagcaaggttcactaacattcttatatttcttcaaaggactgatttggtagtagtatactatggatagactatgggcaaccactgaattctttagtctctaccaatgacattgtctcagaacagggggaaaatttaacagcttatatttattattttaaaattttagatgatcactccagagtgattttgcaacccgtagaggatgatccttcctcagattatattaatgccaactatattgatgtaagtatttttatagttaagtatgtctactttattggcttatatatatgaacctttttgcttattacctataaagtgattgctagctttttaaaatataaaagtacaaactgtacacttttccttgttctgcgtcctagtacttactgacattgttgtgctttctttcacacctgactttggtttgggctgtagatttggctgtacagggatgtaagtaccactatatgtaaataacagcaccctattataaatacaaacattcttaattacagttattactaacgctctgttactactagttatttctgcatgcttcacctaattagcttcatacaatatatctctgttcgtttttttgtaattctttcacatgcgtaaagatctattttaccaccttcccttttcttgtgtagaaaaacaggaccatttttagctttgacagtttattatgtactcgagttttatttgttgatgatttctgtttctggcttttattcttacccttccctaaacatatgtgagaagctggatagtatgatgtgtattagtgttactgaaattttactttttacatttgacttctgacgttaaaatgagtagggagactattttgtgatgtgttgtattggcttttaaagtaataaaattactcaggcaaaataattactaaatttcaattgtaaaatacacatatcacacatatatatcgaatcacagaaatgaaaaaggttgctttgatcatatatttcactgttaaattttgattacatacatatctacatggaaattctttatttaaaggaagtaattatcaaacaaaatatagaatattcttaaagggcaatatattacattacctataaggaagacctggttcataatcaccctggagatcttgggaatgttacttctctctctgtacctcagtttccttatctttgcagtggggataataataacagtactaacctcatcactttgttgtgagaattcaatgaagtaatgcatgttgagcattttgcccaatgcctagcatatatttagcactctttaaacttcaactattttttttacaattaaaatctaggtgtgctataattaaattgattcacaatatgtataattataagacaaaaggtggaggtattaagaatggtagcatatgtatacttctatagacctaaaaggtatgaaacctaggacccaacattttataatttccataaataggaaataattttcattacatttattaggttcacattttagagttatgaattgtcattatgtatttagttgaactaatatattttataaagcatagtatatgagtatatgagttcaatttctgatcataatcttactcttattcattatataaatttatcaaacatcattatgtaaaactaagctaatggtctaatttttagaataaaaaaatcaacagttctatgacaaatttgtaattgttcttacctatttagtttaacctgggttttctgccaggacttgtacactggagccttgttataaaattatttcatggttcatatggtaggactgtattttaaataagacttgttatctagtctttctgttaagaccccagtgtattttggtctatttctatacaatttcataattttccctctcccattagttcattatatgtaaacgatatgagtatatacttctgcaattggtattttttttaagaagtggaaatgaaatacttataaagcttggaaaaatttttccataaaacattgtgctattttccataaaacattgtggtatattaaaaatttgaaatcttccaaatttgcaataacgtaatactcatgctattaaattttaggttggagatctcagttcacatgtatttatatgtgtattgagttgcccacaccagtatgtggacaaattgtaccacagacttttactaaggctcattggtaaatatgcaacaaattcagaacttaggatcatatcatcaacatttttacaacttatgctttgttgttattcaaaccaattgaaagcaactaaaaatctattcctcctcaacagaacttttagcacactgaaaaaaaaaatactaaatttttgctcaagataagatgcatttttaaaaattcttctttccctatatatatgtgtgtatctataattatgtgtgtgtaaattaacattgtgagcacgcacaaaatagtttttgcatatccctgaatgtgttgtagaacaggaatattctctaaaaatctcagcaggactttgattggatgcacacatgcattgtccagctctaacattggaatgttctgttatttttttatggttctaatatgtcctcgtccatttgtaatgcagtgtgttgtacttttggatgataaaatgagaattaatatttttaaacactattttaccaggaatgaatgactaaacatttacatgaaggcataaacattttagtgaaaccaaacaaaatctatgaggttattccatggcaaacaaaaatcaattatacaatatatattctaatcagagcctttaaaatatttaatttttgttttatgtttacctttcagataacataggtttgagaagtgaactatgtgttcactactcatttctggactttttattataacttaatcttaacaggtggttgtcttcatctttttatgccttcattcatttatttctgatattgatgtaaaatgataactaatttgttctcttattttagggctaccagagaccaagtcattacattgcaacccaaggtaaaactttgccttgttaaatgttatagaaaaaacaaacttgcttattcatctatgtggtggtttttattattttttaaattttatcttagtaacaaaaaaatcagcccttctgattaacactgctccttactcatttgtatagtacaaatttattgtgtgtgtaaagcttatataaatttaagcttgatttacttttaattaaaagtgaaagaaaagctggtagtggttattatgatttgatccttgttacacagataggtcagagcactagtcaatagtgccagtcagaggaattactcatttttgaggaaaggaaaaagaagtctcatataagaggcctgtcttcttgcagcaagtttgttagtagtacccaagaccaatattgttataatgagctgttatactgagcaattttttgacgagtcaagactgagacaaaacaaagagatggaatttagtcaagttaattcttcatggaatataataagacagtagagagatcttgttatagtggtacactggggagtaaaagtatccaaataacaacaacaaaaaaagcatctgtagttatctctctaaattgactactggccctcagaagagaaacctgtacatcttttttatataaaaggaaagtaaaacaaaagctaggtttactcttttaacaggggtcatttttctgtgttttcacatatctttggagtaattgagttcagttgtgtactctttaaagttagaaagatcgaccatagtggtgaacaatattcagttttatggtattcggtagagaacagcccagcacatgcttttgcagtttggagatattatgataagattaggatatgtccttacgtgtaaggatatgtttttattgatccctaaacatgcactatttataaatagtgggcacttatttaattggtaatatatgctgtctggttgatggtggtataagagttctattttttacacatatttgaagatgcattaaagtgacttagtgacaaatataaatacccaagaaactagtgatagtttcttctaaattgggaagtgtagagggcaaattgaaaaaaaaaaaaaaaaaacttgtatatgcctgtgtttttgcctattgtgggaatttagatatgaactgaatttaagtattttcagtgacattttgtgttagaccttttttggaattacttagtttactctgcttcttatcttagctaaacttcttactaactacaaaattcctttgataacataatattcaaattaatttctttgtaggtcccgttcatgaaacagtgtatgatttctggaggatgatttggcaagaacaatctgcttgcattgtgatggttacaaatttagttgaggttggccgggtaagaggaagaaaaagaatttttttgtcataaaaatgaacatagttgagaagcaacatgtaagacactcaaaatagaatatcatccaattgtttaaaaaaaattataggcacaacattttagttgagtacttctaagtagaccttgactggctgaaaaattatttgatttctcattgagtaataaaataagctttaattttgtactggaatctaactgcattatcaggcttgtatattttttgtgagactatataaactctgtttattgtataatagatttttttctcatttatagatttttaaactgagttttaattgtgacaaggagttattgctggaattaaatcaccttggctaattagtattatatattcaggtctgtctatatattctttttgtcacttaggttaaatgctataaatattggcctgatgatactgaagtttatggtgacttcaaagtaacgtgtgtagaaatggaaccacttgctgaatatgtagttaggacattcaccctggaaagggtaagtactctaaaattctattttaaaaagtgatatcaaaactgctttttctcttaaaatctttgccaagttctgttttgatgatgctataaaatccattcattcatgtattcattccacaaatgtttatttgagagtttactatgtgccagacatgtttctaaaccttgggacacatgttaaaatcgcctcgtgtggatcttagagccgattgaattaagacagcaataaaaataaataaatcaactaatatatcatacatcatgacaagtgatatagagaaaaataatgttggggaaggaagtagggaatattatttaggcagggtaagaaatggtttacaattctgaaaggatgatcaaagaaaaactcattgttgagaaagtaatatgagtagagacctgaaataagtgagggagtgacgggttatgtccagggcaataatgtttctgacagaggggagagtcatttcagaagcctagaggcatgtgtaaagctgttagaatgccagacagtcaccaggccaagatgtgcagatatccataagtgaaggggaaagaaatacaaaatgaaggcagagaaatcacaaaattggataagtggtgccttgtaggccatgatgattttagttcatactaaaattgagttaggctgccattgtagggtttgtgagctcagggataacatggtctgaattttatttctaaaaggatcactccaagtgttacattgcaaagaataacgtaaggtggctggtgtagtagactaaagtgaaatatagtaacagtgaaatacattttgtggtaaagcttggtagatttgaccacacaaaattgtgaaattacctgtggcacaaaaaaatatcaaaggtacatacagacagaagaaccttgcgattgtttattaatgtccttaatttataatgttaataccagtagaagaaaaaaaaaaaaactagaatctctgaagaaacacaattgttaacaagcctattaaaaatgtttaacctagtgtacttatataccattttgtccttccaaatcagcaagaactttaaaaaagaataatcctcattgattgttagagtatgttgaaacatatttttatacattactgatcatagttaaatcgctacaaaccttctttaaatcaataaaacagtatatctccagagctttaaaatgtttatgtcctttgagaagttaactttcatgaatctctcctaaggaatttatttaaaatacaatgacttcatttatagtattaaaaacttatagataaccataaatgcccaacaatagagaaataattgcatagtattttataaaaatacttgtgagttatcctaccaacatgaaaaaattaggcaaaatattaagttgaaatagcattatacagaacaacataatcatgattattgtaactgtaaaatatgtatgaaaatttcttagacaaatcaagtagaataaaataagcaattgatatgggagatttcagaaagaaccattaagcttgatttaatgaataactagctcatattattaaaaaagaaatgtggaatatgcagtctcttaagttcatacaagtcttgtaaaaatcaatgatgaacttagtaataaggaaaacctgaatacataacaaaaagttgagatattgccaaaatccaatagaaagcaatgatgacaaactgctgaccagtgaccccagaaattagcctattagaagtcaccaaatcctcttctgaataatccttgaatgatttcctcaaaactaaaattatattatatagatcaatagttttacatcaaaatttacctcattattctgtaagaaaaatttatactcataagtgatttctgttttgaaatgtgctctgaaatcatgtgaaaaattataacattggaaaatcagaaaaagtagaatagaacaaaggaaaaattaaatataaaaaagaaacaaatgagaaaaaagaaaaagcttgtttattgaaaagatcaataaagtaattaaaccactattaattctaaatgaggtacaatgaaaatatacaatattagaaaacacagagggacatagccattatacttgctattagaaaagctatggaaaatattatgtataaacttaaaaatataacttttagtctaggacacggattttctgacaaatgctgattctcaaaaattaggtcacaaagatttagaagcatgaatagatggtagaagaaaataggatgattgttattatcattaaaattgcactatggttttaaagttaaagttcctttatactttaaggaatagctaatatctatgttttaaaagttagcataatgtacttggaaggctgaggcaagagaatcatccgagttgggaaagcagaggttgcagtgagccaagatggcgccactgcactccagcctgggcgacagagggagacactgtctcaaaaaaaaaaaaaaaaaaaaaggttagcataatgatgataacagaatcagataaagatagcattctctggagctctcattccctctttcatgatgtctttcttctctctcttcctctcttccccctcttcctctcttccccatgcacacacatattgcagaccaatttcattcaagaacatgaaaaaattcaaaataagatattgaaaatttggatctagtagtgaattaagaaaatatcactacatgacctattattttttccctaagaatgcaagaatatttcaactgtagtgggaaatcttaacaggatatttcattatgtcagtacattaaagtaccaaaactgtatgactttaatagattaatgcatttaattttattttcaaaatatttatagtaatactctaattagggaaattaagaggcatcctaaacatgataaaggtgattcaacaatacctagtagcagccatgttaaggaatgaagaactaacgactattcatttatcataaaaaactagtataaagattatattactgcttctacaatcatgaatgttatgtggataatcagtgtcactaatattaaacatttttggaagttttagcaaatgaaataaggcagcaagaggaataaactgtgtaactactagaaaagacaaattattttaagatgaaaggatttataccaagaaaagtatggataatatttttaaatgggatgtataaacatttatttaaatgaccaaatctgcataaatattcatgagttatagcttgtctttatattagtgataaacagaagtaagaaaatattactaaataatctttaaaaatacaaagtgccaaaatatctcagaatatatttaataagaacgatatagttcctgatttaataaaaacacaaaagtgtacttacggatacgcataatatgtgaatgagtggagacatgcaccatgttccagaatatgggagtacttgatattaatatcactgtatggatttaatacaatcctatttggaaaatcattggatttttttttcttgttatttagaacaagaaaatggggggggttgtttttttaaccacatatttgaaaatcattcagaaaaattaaaaaaaaaatcagggaataggtgctgacatatgaaaatgtactaaaaagagcaaaccctatacatgtaatagaaagataaagggagcaaggcctattaagcaactccaataaaagaattaatatagaaggagtaaagtattacctaaaatcaggccatgaaacaatttttgaccttcctcactagagttgaaaagtagcaaaaggtgattttccattggggtgattccatggtgatgcttatcattgtgattgttacagttatttattgatgatccctgctttgtgtagggtattgtgctaggaattggaattaagaaaacctttaagaaatgatcactaacttccaaggttttggtggtattggtttgtataagattgaatctaaagataaactgtttttctcagttttgtttatttcatgtaatgtgtctaccttttctgattgaacaagtgagattgatagttcacagatagttcacagtagaatttgaattatatagattatagtgggattttttttccttttgctacaaatgtgagttcttaaaaataaattcggcaatatttcatctataccttccaagctgtgctacctcagtctacagacttcttctaaaaaaaggaaggaaaaagctttgaaatgtgcatttacagggttctcttaaattaacccaataggagagcagcacaacagcagatgcttcacttctttcattttgtatttttgttactataaataatactgcgctgaattatttcacagagctaagaaaaatagtttgcccaaagaacagtttagctgcctgtatattttcacaagccaatctagagcagcactgtcctggaaaatccctacatgctatgcttcaaaaccattttcaacatggataagcaaggcattaaaatctctttgtgaggtgagaagctggaaagttgcttttatacaccacttgagaactcaatgcattgggtcaatggggcagcattttagctttcccatttccttcttttcccctaataatttaatgtgttgtcactcccagcaagaaacaagctgtcaaagtaaataaaatttacccagacttttagaactgagcaagacttataattttctttctttggcagttgtctgacaataaaggtaagctcctagtccatgttaggccttcattttattatattttttttttaagaaaaggcatagtctttcgtaaaggttttattgttatcattgtcagttgggtctgtacccataattgtgtttaatggctttattttggccattaaaatggcttttgaaaacatttctttccatctttgcacagagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcaggtaagtggtggtccaaatggtattgactgtatgcaatcagctttttttagagtatcaagacaaggcttttgagcacaaaaactaatgtgtgcttacgaagttccagcttgcttgtattatagataaagtaaaacagcaataaaataaaagttggctgtaagtagtctataaaacaggaacttaagaaatacatacattcatcctaatgcgtgtagtgttatccacaatttaaagtatagaaactctgccttttaatggcaacatctgtgttttttgtttttatcacttttgcaaatcccatattgtatagaatgctaggttgaaatagacatttcttgccaatctagaaaattcccaatagaattccagctttaaaactaaatttcagacatacagagttactaaatggcctaaattgcaaggatttgtgctgcaaaacagctatttaaaaattttttttaaagaattcacattagaggaccttgaaaactgcatcagtgagattcagcaaatatatgccaaaaaacacgagcattatatccagactttcttctgattagaaacttctcttaaaacaagcatttagagatactaaaagcaaattacatggcctcattttgaggtgtgaccagaaaaataagtactgaatctgaaaagcgtttcctaaatgatgctgcacaccattctcatacgctcttccctccaagctacataataggttgtacctaagcattttttgctttctgaaaatccaacctattcaggatttaaataaccatgtataaaagaggggaaaaaaagcagagaatgaagtaaaggtaaaacgtcccataggatcagatactatgtaccctgaaaacaaaaaaaacttcctttcaatcctcctcatgaaatctgatgtactcttaaattacattcctgtctccaactctgggaacagtgattgagaagatggtaggggacaaagataaatagagatagccacaatatcttttgcttaaatttctaaaagaacagtgagtttaagagaagtgaccaaatctgaataacaaggaaataatgttactagcctatctaagcacttagaaaatgagataaataggttttcaacttaagaatttcttgatttatcagagaggtttactttcttatgaattgcttgcttcagaaatgctccaagattctcagatactctcttgaaacagaagtgtcattttccacctacactgaagcatctctggactacaaagtgaattccccactccccgcaaaaaatccttattttgttttccccattgacttctatatataaaattggagaaacattccccagctgcaaaataatcacagtatattacaattaaaggacacaaaatatggtgagatagaggaatacattttagtgttctgtaccactgtaggatgagtctggtaaatgataatgtttagtttgagagagctagaaggaagatactgaatgttcacaacataaatgatacatgtttgagaggacgcatatgccaatcacccttttctgatcactctacattatgtgtattaaaatatcactatgtacccaagaatatatacattattatttgccaattaaagactaaaatataattttttaaaagtatttttaaaaattaactttagaattaaatacagtaagatagcggctagccttttgatttgctgggaatcatattctacacctaataattcattttcatttctcttcagatcatgattcaaatagtctttacactgttactctcctcccctttgataaccgtcattctcttgcccacccccaccatttgcatttcctgtgaagcgtggctcctcagatttcccgtttaaagttttgggaattaattttcttttgccttggtatttacaagaggtgaagacagtgagtgagccaacattctcacattgttgccagaggacacacaactagatgaatctaaaaatattcaatcttgagttaaattttgaagcgtgaatctgccacttgatcaattctatgaacttgaaattatgtgtattaaatttacataaaatgaaaattgtgagagaggtgtggaacttaaacagtgttattttcaatttgaaaataatttagaactcttgttccaatctttagtttataccaaagcagatactctgcatgaagctatttgtacattaataagcttttacacagcagggacaagtgctgtgccttgcagtttgttaaatcaatttgattctacctatctgacagtggaaaaagtccttatttaaggttatgaagactaacatgcttcttacaattcattaaatttaattgtttttcagtgctggtgctggacgaactggctgctacattgtgattgacatcatgctagacatggctgaaagagagggtgttgttgatatttacaattgtgtcaaagccttaagatctcggcgtattaatatggtccagacagaggtatgtagatttacctgtagtggacttttttttattttttattttttttgcaaacaaagagtagatgtctctcatatatactctactcaaccgaaagagatgtttttcatgtgtaatcaatattagctgagtcatatagaaaaatattggtgttttaattcatatttccatatagagaaaattttctgtatttcctaactttgatgacagaaaagtgatactaaaactagtacaaaattttctttttcattcttttggtaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcaggtattaactatttctaaaacctcttttgtgacttactacaatttgttctgggcgctaggaatcctttcaaggaaggtctttcaagtcaaatttataacctttgatcctgttttaaatacaatacgtatctctttcattatacatattatatagtcacttttctattgatgaatttatatctactatatccaaaatgacaaataagttcagacttagggaagagcaaaggggaaaggtatcataaaagtcaaaaattaggccaggcgcagtggctcatgcctgcaatcccagcactttgggaggccgaggcgggtggatcacgaggtcaggagatcgagaccatcctggctaacacggtgaaaccccgtctctactaaaaagacaaaaaaaattagccaggcatggtggcgggtgcctgtagtcccagctactcgggaggctgaggcaggagaatggcgtgaacctggcaggcggagcttgcagtgagccgagattgcaccactgcactccagcatgggcaacagagcgagactccgtctcagaaaaaaaaaagaaataataacaagtcaaaatgagtggtgatttgtgtgtatttagtgtgtatttatagcctttttttcatgcagtcatacagattttgacctgggtcactcacaatgtgatgagatcaagcacattaattataactgagtctgggttcagtggcagctcacacctataatcctagcactttgggatgccaaggcaggcagatcttgaggtcagcagttcaagaccagcctggccaacatggcaaaacctcatctctacaaaaaatataaaaaatagccgggtgtggtggtgcatgcctgtagtcccagctactcaggaggttgagatgggaggattgcttgaccctggaagtttgcttaaccctggaaggctgtggtgagccaagatattgccactgcactccaacctgggcaacagagtaagaccctgtctcaaaaataataatagtaataataataataaatgaagtttgtagtacatgttatttcaaaatagccctaaatgttttcactgcccttaaaacacccctgaaggtgggtgaaaataaaatcaagggcagagaccaaattctttgattgttgatccagtgctctttccaacatgccatagcttatcttcaaatatggcaagcccagatgttactacaaatgataccgtttcccagtgtgatgaagggtcattatcataatggactgcccgattgcattttctttggttaaggcaatgcattttgcaggtagcagtgttgtttagcgtaccttttccttttaagaagaggagccctgaacaatgtgtgtcttgtttctttgtcacttctcaggcttcattagctttaactacaaggtctatcagcctgtcatagtagcaaatgccattgcctcgcacaaatccttcactttctacttggccttctaaattcctgatggatctgtgttatactgttaaatgggtcacactgtcttttaacctgggttctcttttctttttagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacgtaagagactgccctctttgttagtgtagagtgttgtggaaagctacataatgcaactgaacactggctagttttcttttcgaggaaattaaaataacctaaaaaggaaaagtggaaacttttattgaaacacatttttttggaaaatgattttaggttttccctatagagattcttaagaactgtcatttttatagctttattgtagatttggagcttgattgtcaattattatattcatgtagtaaatattgcaagttataaatttcatcttaattattttcagaaaagaaaatcatgccttatctattttgaatataattagaaatgaattttttaaatcacagaatgccaaatcctacaaaaatcatgttaatttgggaaatttttatttctgacatttaatgtttcaataatttacaattaatttgttggccattaatcaataaggactattataagtaactagagaggggatggatggtattatgttaacacatccatcataatgaaagaacaatcttgccccattctaaaatcttaaattgcagggtgttatatagcccatagacagaacaatatggaaagaaagttttctgttttagtttttggtttttttttttttagacagagtctcactctgtcgcccaggctggagtgcagtggcatgatctcagctcactgcaacctccgcctcccaggttcaagcaattctcctgcctcagactcttgagtaacttggaatacaggagcgtgctctaccacaccccgcttattttgtttgtttgttgttgtttttgtttttgagacagagtttcgctcttgttgcccaggctggagtgcaatggcacaatctcggctcactgcaacctctgcttcccaggttcaagcgattctcctgcctttgcctcccaagtagctgggactacaggcatgcaccaccatgcacggctaattttttgtatttagtagagatggggtttcaccatgttggtcagattggtattgaactcctgacctcaggtgatccacctgcctcggccccccaaagtactgggattacaggcgtaagccaccgtgccgggccttttttgtatttttagtagagatgagatttcaccacattggccaggctggtctcaaactcctgacctcatgatccgcccaccttggcctcccaaggaaagaaagttttaaattatgactttggccactttactttgattatgttggaaagaagcaagaaagctatcatggtttataatctttttaaacagtttactgccttcatttctagcttttgccctttctcctatgaaaccatatcaaggagaaattagaagccacggttcatttctttctgactataacaggctttctaagttattgttcctgttaagcccacattctgtttctacgagtagtcttcaccagttactttactctttttggtgctgcaaagcggaatagtctaaaggcaggctctcgtccttgctgtggtcactcttgcctgtgaaaagctctcatccttgctgtgatcggagtcttgcctggccattaatcacatccactgaaatcacattaaatcctaattataccttttctttttatattaggtgtctggaaaggcaaatatactaaatagagagatggcatacaatactttttcatttctgcatctaaatatggaataaaaaaaggatgtgtgaacaagaaaaggagaaaataataatatttagaaaagcattgatgcctttgaattttttgccattggcatctttgtcaaatttttctcaatgtccagattgtctccttttcttttcttttttctttttctttttgagacaagctctcactctgtagcacaggctggagtgtcgtgcatgatcacagatgactgcagcctcaatctcctgggctcaagtggtcctcccacctcagcctaccaagtagctagaactaaggtgtatgccatcatgcccagctaattttttttttattattttttgtaaagatggggtcttgctttcttgtccaagcttgtctttttttctgtatgaaagttgaagcttgtaatccacctgctcttactgtctgcttaatcccctgtgattcaaaaaaaagacatttcatagttaaagctgttctggggatttagtagtgcaaatgaaccgttggagaagtaaagctggtttgatttacaagaacagggtttattgttcacttctttctccctaccctttatccccatcattagtacccttttgccaggtctatgagggattaggagctagggccaagaattctgtaatttcaaagccttacatatgttcctgcatttagagggaaaaagaataggaagtcttcagtcttctcctctcttatcagctcctcctcatgcatatcccctcccctgtggctcaaaaaatgagtagatagccgtcagtctgctttgacttacctttgcatggagcagacatttgattggaagaagagcttcctttcttctaacttttctcattgtattagttcattctcacactgctaataaaaacatacctgagactgggtaatttataaaggaaagagttttaattgactcacagttccacagggctggggaggcctcaggatccctgcaattatggccgaaggggaagcaaacccgtccttcttctcatggtggcaggaaggggaaggagtgccaagcaaagggggaagccccttataaaaccaccagatgtcatgagaactcactcactatctggagaacagcatgggggaaactgcctgcatgattcaattatctccacctggtcctgcccttgacatgtggggattattacaattctaggtgagatttgggtggggacacagagccaaacaatatgactcatgaaccttcctgcctttcttaggagacactcatcccagctgcacgtgtaacttggtaaggttttgaggtcatttagaagtagccaggtaaattattattgtcatctactcagatttatcctgcagtcttcagccaacgctgaatgccatggttggtagcatttcccaaatggtggtagcatcagtgaagtccaagaaccagttcctgtgctgatgttaagattcttgaaggacttaaatagtagtatgatacaaatgagttacaagatcattgaaaatttttgtcagcattagggaactctataatctactaattattattattattattgcaaataattagtttaaatcaaatggcaattgtccagtccagataaatattgtttttactacttctccctttggaaagagataatatattgtgttctaatcaaggaggacttggttaacaaggagctatctccccgcttatgtggggacaggaaatatattgctgttatgctttggtgcttcaggatcttaaatggttgagactgtcattatgacctttgatatatgttagaaatgcccaggaagctgtggaaggtggattgtctgcaagatgtgcagaatatcctggtagtgtccacataatgtaaaagcacaagtgtttgagctacttgtggtttttcttatttggagtggagaagagtaaaacaattttacttgcacgcacacacactatacacatacccagatgattgatagacataccaggggttttgtgcttactttgccttcagcctctcagagactgattacgtttggaaaattgaaatagcccaacaggaaccttacagaggatgttaacctcagaagctttttagtttcttcttttgtatttgtcctgtatttacgtctttcagtaaagtaaaaactcagttattgacttgaattgctttggaagcattgaagtcttccaccaaattgattcattactgtactaattcagttcattccagtggtctgaatctcctattccatggtttaatcatcactctggctccttctgcatatgaagctattgcatcttactggtcctacattgaagtgtattgtatctgtttgtacaaccgatcatacattttaagtttttatatttctccatctaccttgtttcttcacagagctacaggcaaccagctgctttcatcgtcacacaataccctctgccaaacactgtaaaagacttctggagattagtgtatgattatggctgtacctccattgtgatgttaaacgaagtcgacttgtcccaggttaatggctatggattgcttttatgtacttatatacaacttaatagagtagtaatgaattgctaaaatctgctttatactctcctaactagaaaaaataatactctttttttttttctttcaaaacgttcatcatttagggctgccctcagtactggccagaggaagggatgctacgatatggccccatccaagtggaatgtatgtcttgttcaatggactgtgatgtgatcaaccggatttttaggatatgcaatctaacaagagtaagtcactatcggatcctttgagctgatctagaataggtcagtcataaccaagatgtggtataattttattcagacaacagggagactacaattaataagcactatatcatccacctcaaagctagtaaccatcttatgccttagtactcgaataaaaatacaggaaaacagaaatgctggaagctaggtttttcggtcagtcactagactagcatattctctcaggaaatacagatgcactggctcagtcaagttggacagcctaggcctggcctctgagtgtatgtagacttatcttaaggatgactgcatgttttattagtattgacatccagcccagaaatggcatgtgataaaaaaaataagaacattgcaataacaataatgacagagaaactgtactgcaggaggaaagagacatgttggatcaaccattatagaagggttccatgtcactgttccaagttcattattgattatcctacctgcaatttcatcttcctaaacgtctcaacctatggctctaagcagatctaaaggtagaaccagtgctgctaccaccatgccttttcccagcagcaaagtagtaactgtatcgtctttctctgactcctcatttgctttccactacatgacaaattcaatgtgggtggggaagatcttaaaaaaaaaagtgctaataaagcccgggcacagtgcctcatgcctgtaattccagcactttgggaggccaaggcgggcagatcataaggtcaggagttcaagaccagcctggcaacgtggtgaaaccccatctctactaaaaatacaaaaattagctggacatggtggtggcatgcctgtagtcccagctagtggggaggctgaggcagcagaatcatttgaacccgggaggcagaagttgtagtgagctgagatcacgccactgcaccccaggctgtatagagcgagacttcgtcccccaaaaaaagatattaataaaaacaatttagattatgtaaccaaataacaagcagaattggaaaagaaaacattagtaactttcatgaaattaagctctttttagagagaaacattactctgttttttaaagcaccagctctgtgggtatgtattttaagtgtgtgattaggattatcatgtttcagtgtctctcatatcaaaatgactacgtgtgtgtctggttaataagtctatatgtatataactatgagcagggaatggaatcatatcgactcctattgctcatttcagtggagaaaaaaaggataacttcaatcatctcataatattcatgcatatcttagatgttaatttaaatggaatctcattatgtctgcacatctgttacattatggttctagtaatatttgagttggaaaaaaacagaactgctgaagacagtaaggcttgtctgttaattgagcagtttatgtgaaaaatattctaggaacaggaactgaaatgttatatttttgtcagcatatttatttatttgtttgcttacttattgaactgcctctgtatttggtattctggtccttattagtacatgattttttttctgttctcactctcatcatttaatatatttaatatatttaactgcatcaaacatttaacatgtaccaacaagtttgtagagtactaagtagggcttgtaatctaccaaaagatgcatgggctcttgccaatctgatatgatttactcatatattacatattcttcctgatatttttatttcaaggtttaaggttttgattcattctttcaacactactacttttggggaagtattatgcaaagttctactgatacagagtgtaggaaaaaaagatttccgtgtacttaaggaatctttatttttttcaggaagaaaagcattacatgaaaattgtataatcctttttgtataaaagtgatgcattttacagtgaaagagtaaagaatatagagtgtttaactgggtgatctgacataactgtgtgatcagagatgacctctttgcgatagtagtatttaagccaaaatttaatgaatcaatagaaattagttgggggttgatgtaacccaccatcctggtttgcccagggcaggagctttcccaagacacacagccttcagtgctaagaccagagaagtcccaggccaacctgggacaagttggtcattctatttgggattgagaagaccaagcaaggaagaagtattcaaggcaaagggtacatacagtatatgcaaagtccccaaggcaagaagagacttgatatatggattaaaagaagacaaagagaaggttgaagaagggggtggagccagatcacataagtttttttaagccatgacaacaatttggattttatgctaagatcatttgaaaatcattaaagcaggaaatgacaagattgtatctgcagttcaaaataatcatgatgcctatagtaagaatggactggaaggagatcaaagtttattcagggagatcagctaggaggtaattatcagaacctgtgactagtagtgtattgatgtcagtggtgataaagagaaggcaatgaatctgaaagttatttaggaaatgtaatcgtagtaatgaattactggatacatagtgcgagggagaaacaggtataaaggatgattgccatgtttcctgctgttgtcacttagaatgtttttttactagcatgtacatattgaggatttatatcagctagactcaatccagtgtagatgccatttgtattgtaaattatatgcaccttttactttttagtaaaaattgtagtcccagcgtatttacataaaaacacttccctctacagccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctgtgagtagggcagctcagcctgtcattcatggggccttggtgcttattttctcattttcaatgttaaagactatctggcttgcatcttatggacctcccatagatgttatttttaaacagtcttcctgtctcatgagtctataattaactactaagtttattttgtatattttctaaatattgattattatatagctatattatttaaactctttggaacactactcgtaacaacttctgatttacacagtttacaaatatatcagaatctcaaagtctagattgcagcaatctatgcctatagcattttcctgagtataagctactgatctaatttcatcctcaagttttctcctctctgccttgtacacatataaagcaaaattaagacacaaatggaaaacaattaaaactacaatgtcttattttcccaaacatatatgatggtgtgacctgtggtcacttggtgctgctatctaaaatgcctttgctttctttgctttcagaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggtgagtcacagaatcttagatttggaaggcatcttagagattagttagtcatatacctacttattgatttgacttcatacacacatagggaatcagatgtgaaaatgagacgttgtggggactttcctgcctaattaatacattgctgagcatccccctctacccacagacacttaatcacgtattgcataaactgctaatcatgaaactattttcatttaatttgggaaatttgtaggattttttttctgttatagccaaaaaatatttgctgcagtaaactttggtaaatggtcctataagaagaataaatcctatatcaaggctgtatgtctaagggatataggtttcatcagtaccttagacacccagtatttttaaaaggcaatgaaatttagttttgtcattatctataattattcattcattttctgatcaaattgtaaatggttaaactatcatggttaagttttcagcttttaccaactgtagagggcagttcatatcatgctacttgagcttgtcaaggctcgtaaagtcagaacatagcttacaaaataagagctgataggtatgtgtgtgtgtgacagttcatctaggtgaagctgtatgcagagtaagaaagaaagttacacttatctaacacattttacttctaacgagagatatctgtgggttacacatatgtatgtgcatggtgggatcaggttgggagcagctgtgtagtgtatgctcacagaaaagtaaaccagaaaaaccaaggcatcattgttgcttgccctacatttatcaagatgatcagataactagaatgagcaattcaataaacctttaaagtatttcaccacttcctgctcatggattgctcgcacaagagttgcgttgcttcctgagacaaaatctgaagacttaggtttgtactgtttcacttttacaagcggtaccagacttccaccctttctacaggtgtcctcaaactccctacaccacctcatttccctgggttgttgcagctgtctacacaagattacattggttttgattggggtgctggctatggagatgagaaaggggggatgaatcggagggatttttgagggagaactctcagatcgtcttagcaactaaatgaatagtggttatgtctctaaactttgcgatttgaagatttcttgatgtaaactctgcctccatttttcaggtcaagtcttaaaatcatcagtgggatcatttctgacttcagaattcaacttttaccttcaaatttaactgatttcccaccttttttaattaaaaaaaaaatctatggttaaactgtgccattctgggaccttccaaaaagttactattttcctttacattcatgtcccgtgaatcctgaacaccccaccctctgatttgtgtttaatcagtgttgatgattagtttagtgagctgtggagttgagctgaggagtttggtgaggagatttagagtgaaggcaatattgctggagactgcttaaagagacataactatttctaggcacattttggttccttgaatgcactcgccacagtggtaggtgaatttgaatcataactacttggtgaatagtgttggaatgataaagacctcttaaggaaagttttattaccctagtttattgctggagacacctcgaacttctattccaaaataatatgcattttagactgttctccagcctgaattttacccacttgaatgaactgagttgggaatttttaaatgaattgcatattataagtaatagtttatgatatggtctctgaatttttctaaattcttattatggagcaagtccatagatgggcttagaggaaaggcagttttaactcaaaaattttattgccaatatgttgtcttaaacatataaaggcagcagaaatacattttcaggtataagtaggctcaaaatttaaggatcactaaccattcttgaaaaatttgcttaaatactctgatggacaaaaacagtgtcaaaaattaagaacttgaaattgcataaatggctgtttaaaatggctggctttttttttctcaaggaaatcatctgaaatatatggagaaaaacatttgcagtttatcactgtagcattataaaatagagaaaaaaataaaagcaacttaatagtcaaacaatacatatatttgatttttatgtggtattaaaagatgttaaataacatggaaaaagaattgtaacaatgttaaattttaaaagttacatttaaaattatattttgaaatatacatagttatatttattctaagataattatttcaaccatgcacaaaaagaactgaggcaaactaaggtgatattttaacaatttcttctgatgatagaattatagctctttttctcattctttatgtttgttcagaatgtgtatattctttatatttgtacagaattgttctgtaatgatcaaatattactattataaacagataaaaaattatagatatttaaaaaattgatagaaaatatgcggcaaagataaaatgtctttttaagataaatttcctttttcttaaatggatcattagactcaagtataaaatatgtatgcctagatattaatctcatatatagaaaaaataaattgtaatccttgagtaatctaaattggttgtcaagtttcatttggtaactgttattcaacattagtctctttcttaagttttctcactctttgtgttttgacatctttcaggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagtta

SEQ ID NO: 2 - DNA, 37 bp, Artificial sequence
  Exon 13 of human PTPRK gene (ENSE00003480723)
gaaactaaaacccagtgcgtacgcattgctacaaaag

SEQ ID NO: 3 - DNA, 78693 bp, Artificial sequence
  Human RSPO3 gene (ENST00000356698.8)
tccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagccggctcccaactgcagcggtcctcccgccctgcgcctcgcagaggagatgcaggttcgggctttgggggtatggacggcgtctttcacccttgcctctcggcgcccctgccttccgcagcatcctagccggtgcgaggggcgggcggacgcggcgctaaggtggctcccgccccatggtaacttcaggttcgcgggaaagttcggtcctgggttagactcgcacccgggatttgtgctttccttttgaggatcggacaggggcacccagccgaaggcacttgggactcccagacgcaggatgcctctgaccgctgagtaaatgacaagggaggcgcggccgcggtacccgctcacctagcgcaaccgcctcgcgcggggagacctcggctgggcccttaggctggactccggtagccgaacgcccgctacccggccaggaagccagggagcgagcgcctgcgcggccgcatccccgacacgcaccagcggagccaaagggcgcgcgaggcgatggggttcgcgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcagcggtgtccacgcgcctggcggtccccgcctcctctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccacacacttgtcaaggagggacagggtactgagtgtcagaggcgtctcgctttgcagttttggggcccctgattctgaaggaagacacaggaaagaaagcttgtagtccttttgtgcccacctcccccagcgaggaccacggcgcaggaagctttccccgggcgctgcctcagggagctgtgggatgatgcacctctaggttgggccgagaggagtcaaaaggcaaactgcttttcgacctgccttaatcatctcaaggccaagtcaaaggagacctctgtttgtgttgaggggatgaaagaaggaatagtggaactgggttgcaattccaatttttctgtgggagtgggactgggagacagcacccacagcgatgctcttgctccttcgcacttgagtctgcgtttgcggcttggtttgctggtgcaatcctggtagaggggcgaccccttgcgtcctcggaggagacagactagactcttggcaggtgcagtatgacttaaggaggaaggagtggagggtagagaggtcctctttaaatgcccagaaactcaaggtcaaactgcatgtgcacaaactcagatataccgtttgttttgaaatctctgggggaaaaaaacgaacaaaaagattcaattcacagttcctgtttctcaagtaaggactaggaaaagtttttaaaatgaaaacatgtggtcaaacgtgttttcaaaagaggctggctatcctaattgtttcttcaagagacaattaagtgaatatttaaggagtcttctggcctgtagttatatagtttcaatttcctaagcttaaaatcatcaataaagatatgacaggtagaaaattaggtgttaaaaacttctacaaaaaatttaatggtctctcttgatttagtaggaaacttttttgtaaacaagaacattcatttgaagtgttaaatattgtcatgtccaaagaatcatgcattatcctcagaaatagcaaataaagccatatcagtattctcctgtttccctaaaacaactgtaattccatttgtctctactttgatataaactagtgatcctagttattacaaactagtgtttcttctcataaaagaaacaatgttttaagacaagacccttgtactttaaaatgtctatttagttatgggtgaataaatacacaataaatttttatctatttgaattggtatacagctcttaaaaatgactcaacctttgaattccagattgtgtgctaataacattaagaagcactttttttttgccataatgatagccacagaatcttagtggggcctcacattttcacgtggattagttgcttgggccctgaaatagccactgaagtgaagaagcaggtacttatcttcccatcttagaaagaaaaggcctgagaactagaggctcagtaacctacataatgccatatatctagcaagtggaacttgtctcctgccatgaatctcacagttatgtacacctttattctatattctggtcatagagaagatatcaggtttattaagtaataaattagatggtctcaaggccatcatttattcaataggtttagagaataaactgttctccttgactggaaatttttgaactcattattttatataatggtgatcaatgtcaaagaattaaatacctaatagtaaagttttctaaacggaatatatcatttgattatctaggagatactatgggattattctgtgccagaaggttattgttagaaacatcagatggcatttagcatcctttttatttgatgccatctagtagctcggttttaattgttcagactctagataaatgcaagttttgaaaagccattatatgcataataatttaaaagcactcattgcacaatctataaaacttcgcaagtctttcataaagacgtctgaagaaagagagaaagaataaaaaggaaataattttcatggtaataaaataaaaacagactattggaatgtactggtcattgctcatgacattgtttcagatgttgagccagtctttgaaattatgacacaccctttgtgattatgttgtgaatcctggaaaataacaagttaactgataaaatagaaaaatctttaattctactatacattttgtaatattaatttcaaatgaaagtttggtttggatattgactacaatgtatttttcacacttgtctacgtttctcaccagtctgccttatttttgagagtaacagtgttttaaagatacagacacgaatagaatttgctgaagaaagtgtattctttgatacgtcgtgtaacagctgtataaatcaagacaaatgcaaattcatatgcggtagtggcaacatctaaatgcaaggaaaaacatctttgtgaactcaaatttaatcatcattacattatcagggttgtttctcaaaatatcccatggtgacactattttaattccgtttattactttaatagaaggattttaacaagaacgttagaaatggtaattttaaaataccttctttttagccccaagttactcaagtaatgagaatgtaagaatgagtatgaaactgatttaatgttgttatttcaatattcctttaaacatgaaatatgaagagtatttgaacttgcaaatagataagctttactaagtcatttctccattaaataattccctggcatttaatattgtacaaattaggtccccagaaagcaatgaatggaaattacaacgtgtagtaaaattttattttccagttattatggggaaacccttgctgcattgctccaaaatgaatttattagacatctgattattttagattatttgaatctggacagagatctccagattgctactaaatgtctaaaatattttctagttcaatggttaatctttttttagttgtaataattcttttgaatcctatgcaatgttggcagagtactatgtagagttttcagagccctatgtagagttaagaccaaaatacacctctgcaattataagaatgagctatgaaaaaataaaactattctagatatactgatttgccaaattgtcttttcccctttgtctccatcccaatgtttcattttggacatatcttgatctctctcttcctacttcttcactattcactcacatatcccatccccaccccaaaaaaattattttccaagtagtgaattcttgaaatgccatcagagtggatattgtgtttcatgaaatgtaagaaaaaactttggttaccattaggaaaacatcattcagttttaagagcacagtaaggatcatgcaagacagtgtgttgaaattatgtttgacttggttaggactatttcttctaacagtgcattatgtgctggcattttttttttgaaaataataatttgaaaaaatgttgcatcataaattgcacagtttttttttttgcttggcctttgattttaagggcaaatgtagattgctttcttaattagagatttttctcagggtttcacatgattgaatatcttaaaatttaatatctgacaacctagtaaatttgaaatgctttgcaaccataactaaacacatgaagtacagcatatacatatgtaaaagatgctagccatcttttctgtttcttcaattctgcccatcagatctttccattcaggaatattactggcattctgattaaagtagtcatccagcaatactgaaaagaatggggtgttccattctcaaagactgtgggggtgctgagaatgctaaatatctaaatgtcattgattgctaagaatcccattttctgctctaaagtttcaataacatggatcttttaagcaaaatacctgaattcttttcacatttgaactgtttgaataatttttaaattttatttttaaaaaacagggttgcaggtgcctcttatctgataagagcatttctgctttatttgtcacttggcaagggacctaggtgctatctgctgtagctaaaatttttcttgaatttttttagagaaaattcattggtactaaagaatatgattgtccaattaaataaatatttaatggcttttaactgtccttatgttttatgcaaacatctaatctactcttcaaaacaccgccttattaatgtttcatctgacctttagaatttaattaattgcaagtatcataagtttgtggtagaatctgagacctgagaaagaaggctccttagtgtatgttgggagaaggtagactcagaagttaaagacctgggttccagatccagcattgctgctaatgcctgaataacccaagaaagtccttttactataccaagctaaagtttttcatctgcaaaatgaggaggttgatcaaaaacttagatctagtgatccctacggtttcctcaacatttaatcttttggtatgagaatataagtcacaactagggagttaaataataacttgtcttattcaactaaatttaacagataaagattgagtacaaacaaacataaacattcattgattataagtaaatttatcacataaaggttaacgagtaagtgatcaatgtggataatgaattaattatgatatacctcataattcacattttttattgtctgaaaaccatagtcacagcaacaatcagcatactcagtctaccccatcttgtccttaggctcagggttagggagctggatcagaatactgactcaagggtcacttcagagcttccctagcatggcaggctttcagaggtggcctgtaattatgaggaagagatgatttacaatagtccaggtttaagaaaataaggccctaggctacaacagtgaatgactgcacaaaagagtatatacagcagataatttcttttaatcaaatcagtagttcttggcaattaattgcatatgaaagggaaagagatggaggcccatatttggcaataaactttggagtataaggactcaggtctgggtgaatggaaaaatgatgacgatcaacaaaaagaaaaataggagaagcaggtcttgttggaaatctgtttctcttttgaggagccagtaggacgtttaggaactcaaaactcaaaacacctgggattagagtattagggctgaacacaagtacttcagagtcactcacataaaaatgatgtttattattatcaaaagtgtgtgctctcctactgatacgggggtgtaaaaaatgtgtgctgtgatgacattgagactcactcttcttggtaatgtcaaaataacattaattacattaaggtaccttgtctattttaagtagtttaatatatcattttcaactgtggttttttatggtttttataatactctctgtgttacataagaggatggtcactggtatcataagctgtagttgttgttgccaaatcttgcagctgaaaattgcacttagaagtcttcttacctgtggaactttgccacagatcataaggagacctgaaaaactatgataatgaaaggcaagtttacataaggtataaaaataaaattttgaaccattgaattgggtgcagtatctgttcatcactgtagcgttctacttttaagtagatttctctacaaagtatgctctcttaatataagagaatctctggaagggataaaacttgaaagaatccagtccatctacacagtgtgggatcacttctacaacatccccactgagtaactgtctagcctcagtaacagtcagccccctaagctctccccctttttcctcctatttttagggcttctgtatccaaagcagtttattctcctagtcctcttctttgcacttggcatgggcatggtattagatctagttaccttaaaacacctttctaaaatgaacacacagtaacgcaatgtgctacattcactcccaaaaattgtccttagaaaactagctggtaagcatatttataattataccccaatacaaagcacattcctgacagtaagtggtaaagcagcccccattttataaccacataatacaaaccactaccacacaatataaaataacagaatttgtgagctgcttattttagaacactgttttcttaacatatgctcgataagttggtaagaaaaacagcagtcctttctcattgttttttgttcccctgttctacaaagagacttcaaaggtaagaacactgtcatctcaacaaaggctgtcatatatgcaaagcaaatatcaatcacattttgccaacaagaaataatatgccaaagtatgtgtaagtgctacatggcaaacaacagctttttagctctcagagccactgttatatttatgtacatcttatctaaatatgcatgtatacttactaaagtgagtattatgataatagttattactcaatagctcccatgttataatcaccagtaagtgccagaccctttgcttgatgcttttgcaaaaattatctcatttgatcttcatacccacctgtaaggaatgtgccaatagtcccactttcattgatcactcaaggaattgaggtggacctcagattccagtctaggctagactccaaagccaaggtccttctttgattcttcactccaccttaacattagggttggtacttgaggcaatcatggtgcattttctaaattccacccactctttctttctcttactctctcttctttcctccttctttctttatcctcatttaacaaaccataagccttttttcaaacatttactataaaggttgcttctggtattcaagtaccctcctctacatcgctttcttttccttaccctttgtcctctctttccttaaacctgtcttattgatgagttttaaacataaaagtttgctgattttttcattaaaagcaataggattgcacagtttatatgaaagactctgtgattgttatttccatctatggtgcgcgtaaccaagaaaagattaatgtaggcatgagaatgttagaaaagtctgtaattttgcagttaaaaatcagaatccttctatgtaatttacaaccacaatagatattttactggctattgttatccagaaaaagttatctttatggcacttcataaagtctgttatttatattacttttaccatgagcattaacagtaacctccactctgaattcttgctttatgggtcttggtacaataattttccgccctgaggtcacattagaatttcctggggatctttaaaaagatactaatgcccagactccacccttgaacaaataaaactatcttctccacccttgaacaaataacacaatctttggggatggtacctgaatatctacattgtttaaagtagttctggtgattctaatgtgcagccaagactgagaaatattgtaagagccttaattcaataatgactattgcagctaagcaaccactgaaaaccatgccagttttgggaaggctagacagacaaaatagacgtatgtggagtgtgattacaaatgagatagatgtcatttgaacaaatagtagtgtaaaatataaagtattctgatactgttgatcaatactctattgatctgtattgttgaacaagagtattattaaacttgtagcactgattggtacagacaagactgtctgatagagaattatctcagtcaaaagaacagagcaaaatgcacacaataggacacactagtgaatgtaacagatgctggcttcatagaataagaacacagctactaggagaggtacaaaccatgggggagtgtctttgctgctgagctatattgtgtggagggagtataaataggacagttttagaagatgggtatcagccatactcaaactttttttcaaagctacttaataataaacaactgtttttatgtcttaccagatgactggtaatgtgccctagagtcctccttgtttttagggaaaacttaatggttaggaaatacctaacgagaaataaatgtccttttcttttatagtttctacagttcctgactcactttagattgactactggtgatcactaaaacgactataaatagcacagttttaactctaccttaatgggttctgttttgcagtaggtcatttattcatgaacttatcatttctacttcactcctaatgtgctcttctttgggtagttatctccattaaatcgtgtttatgagtcttttttagtccatgaaggattttcaaatcttgccataaactggggaaagttccatgtaaaagtggggtggaagtctgggcttcctgacagacttaatcctgctagttaagggggctctttgggataatatgggttccaatgagtcactaggccaaatcccaataaccgcagttgccaaaagtaattagactgaagaaagccaggctccttgggaggaaggtcatcacagcgagctttagccattgctccaacgtcagacctagttaattgtccctaaggatggagagcaatcatgagttccagagagtaggaaatataccagaaaacaatgctttttcactaatttttttcccaataggttatttaccataagcgtgcaagagatggaaatacgtcatcagtatgtgcagtttatgtcactatcctcataaaccaccttgtttgcctgtgtgaatgtacgtgcccacatagagaactcccaattcatcactacaagttctcctcctcccttcctgagtagataaagaactcaaagaatctagtctaagttcataaaagaaggtgtctgactagcatggaaatggaagggaaggaattcttgtaaacatccttaggtcaacttaaatatcatattattgaagtaacatttggcaacaagaaaatggtagtacattatatcagacaagcaattctaaaatatctggagctagaacaaacttatgatttcttgtactgaaaataattcactttagaaacatggtgttgtaagtatctaagtagaaattatcaacaagtaagtggtgctataattttaagctttcaatatttgagaaattaaaagattgttaaacctttccctaggaaaatactcaagtagcacaaaagtattcttgctcaatacccaaagtaaaaatttgcctttgaaaccattggcttggatacccagaaaagatactccatcactttatgtaacggatctttaattgaacaaagacactgtccttacagtggtaagtttcaaattcctttatggttcagaatgacttcagtatatttcagcactcttttgagcttagactaccagttctcagtttaaatatgtggatgagtgatattgcttattttaaatctacaaacaggaagtcaaactctttttctggccagctttttctggcaactggaaatctccaggtatcatctggcagacaaataaaccctgtccttgtgcactgcacacatctaatagttatcatgacctgattgtcactatggccaatattgtggaacaatgtatttaattttctttcatcttaaattgacaataagataaccaaagaatagaagaatcctaattttggaaaaacttagcaaaattttttgctgtgtttacttgtaccactggtcatgtagtttctgccataaaatacaaacggtatggacaaatgctgcttggccacaaactgaggacatactgagaagctacatatttgtttcttatagaatttagttttgtttttcaatttatgatgagtttttttttatatggagtccaaaaggaccctcgttgcttgtttggtaacaaggaacaaggtccaaacatggtatccttagcccctctgactttaattcacacactctcatttcatgccatcctcaagatggtaactctcagtcccctccacaaagactgaatataattttaaaaggacagtctttctttcatatagcacatttctaagacatccagccaactttccagttctatccagagcttaatgtagatccaagcttttaacacagatcagtgggatttccttggaggccagttaggcttgcagtatcacatagatgcatacttggccctagtacaatcaataacatttgctatcatatccagcctgtgtttttaaacctgtgggcattatgtgaccataccccaaagtttagtttctaacagaataagggagagttgcagcaagagaacctccaaacaatttcatgctataactaccatcttcagtatccatgtggacatcccattgacattccaggaattcattttaaactgtttgcctctgaactgagtatgtgctctaaggagagcctacgatccaagaaaccttcatgtaatagtttttacccaaactatttaattcacaagctgttgggctgaagtgctctaggtcatcagataagaacacattcaaatgaaaattgccaagattttccagtgcaggatattttcgtcacccttcctagctcaaactcacttcctcatccactccacaaattctaaaccactactaagatgagttgaacagtcttaattttataatcttccaaagaaaaaataaagacacagacagccgagttaatttataaaacagtgctgcatttatcttggcagatgtcagttttccccccactagctctttcatgctgactacttagcaactcatggaggatcaagtcattcctatgtatcaagcaccttgagaaccattgcactgaataagtttggtgtgtctcttcacacacttcttgtacaaatttctttcctcatagacaatttatttactgggtctctgaaacctaaataatccctttactttaaacctgaagcaaatggagagtcatttttacaagagcaataaactaaagtggctgttcaaacactttacttgaattgctctgggcactgaaatacctttttgttaatacaaacccttcatattctagcaggaaaacccctgaaattctagggttgcttaaaattgtgtaaccaggaatctcccctctcccccaacaccagccccctgatcctgggagtatgccagtaattttgcaggattcattctgacaaactgttctggtgtaaatgtttatagaaatcttttccactagagattaaacaaagtttaagtaactgtgcctaaatgatagatcttagtagtgtttgcaacagcaggtctgatgctatctgatgcaaagattctgatactgtatactagagaaaaggctaaaggaaaaagaatcaagagaggagttagtatgaactgtatgtaatttgaactgcaaaatattattctaagttatctctatacagattagtttttttaatgtgcacaggatataagggaaatgagttcatttaaattgaaaaatagtaaaaactgactactcgtgctttaatggcttaaaaaaaggtgggggcaattacaaatcttatcacatgccagttcaaatgcaattcttggctagttctccaaattctcaccaaaatgaagtaacatatctgagatctgatctgatgtaagctctggtatccatattattatgattcaaaaactactaaaagggataactgctgagctctaagccttatattgaatattatttattaaaacagggtagtaccctaggcctcaagaggtgaaagcaaaccagtgttccctttctgtgctttcctgtttgcacagcattttcaagtgtttattatatactaagggattacacagctaagcaattaaaaacctcagaaacttcattgactgaatttcaaattaatgctacagcattaatgattcctgtgatactagactaggaaaggcatatgtcatttagactagttaatgtttcctctttcccttgatgatttaaggcctaccttaaaatttaagaacccatgaatcttaatttcatttctttgttggtaagtcacaatatgagatttcttcttaatatctggagattacttcctcattacagacataggatttttttaattttaagatttctttgtgaaaaaccattttagaaaaagttcaatgtaaataatgttaaaacatatgcaatggaactttactcctttttgttttgcttcaaacgtaatggcagtcattcactgctaagtttccagttgaatcctatttaaatactgtatttgctataaatgagcaaggaaaataatcaaaagggatccatggaatatgaaatagagactttataaacttaattggaagataatcctgtctttctaattaccttcttagaatctagattttcttgatttgactgtagtgagaaaaatcccaccttaggaggcagggacattgattttaatttatatattgctatataatttagacaaatcatttagtctgtgatttgattgtatccactatacaaatgaattcataatctttcatttatctgaaagcagaaaactgatcttaaagtccactcctccaacagtaagatcaatgagctttcccttttcatttttgtagcatgctctaaccttagatagttgcccgtccaaatgtctagaatgctgagttatggctagaattcaaaagtttaagtttctttttgcacattcatggaagttttagaccatatttttaaaaagctaacaaggcaaaaaaggaatcttgttaggggaaaaatatggaaaaatcaaaattgaactcagcactaactacaatatcatacattcatttatttatttaatagctctttattaaacaattactatgtgccaaaattacgaaaatgagcaaaacacacctggaacttacccttgtagtatttcacagtggttaaggaaagaaaatattaattcagattttaaaaaacaatatttggctaaagataaattagagcactttagatatcatttctaagccgaatagtacctcttttttgatttgtttaaatagcgttggaaattaattagtttacaatgaacctaatagctacccagatttttctctgggaaacagagacaaagctgaacaagaccacatatggggatgaagcaggaaggtggaaggaagattaactgaaaacatgggaatttattaggccttctggtattttcttgtcttaaaatttatgagcaatgaataggactcattacttagcatgccgtttgtgacaatcataggaagtatgctattgtccactttaaatgtagttagcatttttaagtaagccttgtaatggtgtggcatagcttggctgagtgaatttccatttttggcacattgactaatttctatagctgaactttcacaatagttcattaactggaattacttttcccaaacactaacatattgtatgttttaaaatagtgcattttttgtccatctctctgaagcattttcaaaccttttatggtaaccccatgaccaccacataaaacatacaagtcaatctacttaaagcaccagtttggcaaatatatgtcaacaagttatttggattcttatgtaactttgttgatgacctttcctaacctcagttgatagctttaaagatatcagttgccaaaattcagagtcttgaaaataacttgattcaattattttcggtatgtgatcactgacttgtaaaggtctttaagtaaagaaaggctactaccagctacttccacatgtttatctcatggaaccttcacaacaatttcatgagatattattccattttataaataaagaaattgaggctgaaaacaactaaggaacagatcaaaatgacatagtcagagatggtaaacctaaactgtacatctagatcttctgacctaatgaatagctttcccaatacaccctgcttttcattaagcctgtaaaagagaatgccagaggaggtttaaatgagaaatagttatctttgcaactgagatggaactactaatacctcattagacaaaacgtgagggtgtgagaaaataaaccagactacttgacagaatggttacttaggaagtgccaggccaagttttttaactgtttttaaatcagaggcccaataagattgcaactattggccaggtgcggtggctcacgcctgtaatcccagcactttgggaggccaaggcgggcagattacgaggtcaagagatcgagaccatcatagccaacatggtgaaaccccgtctctactaaaaatataaaaaattagccgggtgtggtggcacatgcctgtagtcccagctacttgggaggctgaggcaggagaattgcttgaacccaggaggcagaggttgcagtgagccgaaatcgtgccactgcactccagcctggcaacagagtgagaatccataaaaaaaaaaaaaaaaaaaaaaaaatttacaactattgttcttaaaagatccctctgattggtaatggtagcagtagtagtagtaggaaatgggaagatgtgaactctattaataagggaggtagaatctgtaagaaaggtgattggagaagaggataaggagggctcctagatttctgattgtagcatcttcatggcgccatttgctgcaacagaaaagcacatgtcgattagatgtagtggctctcacaggtaatcccagcattttgggaggccaaggagggcaaatctcctgagtccaggagttcaagaccagcctgggcaacatggctaaaccctatctgtacaaaaaataccaaaattagccgggcatgatggctcaaacctgtagtctcagctactgtgggggctgaagtgagagtatcacttgaaccctggattttgaggctggagtaagcagtaatcatgcctctgcactccagcctaagcaacaaactgagaccctgcctcaaaaaaaaaaaaaaaaaggcacatgtcaattaagtgtacaatagttttaatagctaggaagatttgtgtgaattatatatgcagcataaaccactcatgttactgaagaagataaagagagaccagagaagtaagtgacttaattgaagtcactttgcagtggagccaagagtagaaataactcctgtagccattctgtaataccaaatgctacacagcagatggttccaagggttgaccttccagagaagggctctatggatcctctgccaatctgatttcttatgtgtttaataatggccttcttggagagaattatctgttcattgactgaggagttgcttcacagtctctttatttccttactccaagatatgccaaactttaaaaagttacaataacctgttgccctaaagtaagatggctcatgacaaggcacaattttaaaaaacaaaccaattacacatgccgtactctcatcaaacacagttatccatttcctcatcaaacatattctattcctgggaatgaggaaggttcaaatctgatcctgagctggaaaagtatcattttgcccattatcagcaataacttatattaatatgattttgtacagcatatagacactttctcatcgtcttatttgatttttttctcaacacccttttggaatgggcagaacaggtgttatcatactcatttcacaattaaagctcaaagatggtaagtgatttgtatggtatcacaaggttggtaagttgcaaaacttagcctcaaaggtcttgtagggggatagttgttttgtttttctacagttctatgacttttcccacactaccacagttctcatatatctaccctgaagttcctactattagtataattcctttggatttgacaagaaaggcatgtatattagaggaaatctttattatagatgagagtcttactagctgacaatgtgaactggcagatctttaacgtcctgtcccatttgaatacccatgaatgagcttattgtggggagaaggagataccgaagcaagagcatcaagcattgtttggcaaactgtcttcaggaaaaagcagaaaacttgctgggtattctctatggtagtagaactttctgagagaaatggttgagttttgatataatgggatgtttattaataaatgtcattatgggctgggcacggtgactcatgcctgtaatccagcactttgggaggctgaggcgggtggatcacttgaggtcaggagttaaagaccagactggccaaatggtgaaaccacgtctttcctaaaaatataaaaattagtcagccatgttggtgtgaacctgtagtcccagctacttgggaggctgaggcaggcgaatctcttgaacccgggaggcagaggttgcagtgagcggagttggtgccactacactccaacctgggtgacagagagagactccatctcaataaataaataaataaatatcattataagataattgtatgggctttccccaagtatcatgatatttgttttactagacataatcaagtagactgttacaggaaagcagtttgaactagatacctctaaagttcccaaagtttatgattctattggctggaagctgactatatggatctcaatattctcatctgcaaatttaagggagaaggaagagcttcaagagccctttaaattccataggtaaattcaccatcctttcagatattatgtatgtattcctacataaagcattttgttcataacattttccctccttccccctttccatttgtctcagtttttcttttccttcaagttccataatcattcctatctgttctctgtagtctttagatatctcaattatcaataattgctcctgccttttaatttgcggcaaaaagtttctaatctatacatttatgggttttagaatattaaagtattatcttattaattgtattgtaggcttcttgagtcagagactatcttttgtctctcagtatgatcagtacctagaagactgcttccagtaatcattgaataaacaattatttgtgaagataataataatgtaatactgaaagtgtggtatttatatcaccttcgtcagattcacctgggatgcttcttatcaatgcagttacctaaatccactggattcacttccaaatcaaaatatttgggagtggcatcttacctcatcattgtaaacaagtaatccaggccatttttacacacagtaaagttttagaatctttagacctttggtttctctgtaccatatagacctttggtttctcggtaccatattgatatcatttctatgccatatcttacctttttcagtctgtttaagtaggtgtgtatcttcagtgagcagctagtgcctcagaggtcttcttgacccggatgtctgtgactcctattaaagtctgtgtctatggtacttaaaaagtagccactctatgactgttagtgagtttctggttccccaagcttctcacacctcctgtattagaagcctcagtatgtatcctcttttctaagagttattattggataaagctgccagctgcttcaaatatggatgatgataacacaggatgagtttagtgcctcttgagttaaacaaagtgtcttatacctatgattttgatgattgcctaagagagtcctaggcactttacacagcatctcacttaatcctctcaaatacatatcaagcagatattctggtgttacagatgaggaaacctaggctcaaaaaagttaaacaacttttgtctaaatatataatcagactggaaattcatttacacagataattggttatattcatctttgtatgctcacctactagaacactgtgtggatgttgaataatttaattttttaaatgaataactggataaaaaataaatattggtaactcagctagaaaacatgacaactagggttcaaaaccagactctaaatgagtgcagatccagtacctcttcaccctgtccctgtgctcttctgggaagtgtgcaggacccatttctgaatgaggtcacaatgcagggagccatgcacataagtataaagatgcatcatacttacaaaggtgcatgtatattcttcttcaattccgttagcaattggagccatgcacataagtataaagatgcatcatacttacaaaggtgcatgtatattcttcttcaattctgttagcaattttgtgaatctaggaaaaaaatcacttattttccttgctcagaattttgtatgtgatacataaagctggagtttttaaaaatggtatactcactattggtacatcttctagtgcttgttgaaataccacaagtctctcacttgctgtttacttatgctaagacctcagccatcagatatgctactttagcatgctatgtagcacaaatatccaagtttattcacaatataacaaagtggagtttgtttttagcacaaactgaagtttgtttcattcaagaatgtgaagttagtagttatggagcactcatgcggattcattaccattaaactgtcacattttctgtttatgttgatttctaattatttctaaccttaaaaaaaatatatcttttttttaaggttagaaaaaaaatatttctaaccttaaaaaaaaatttctaattatttctaaccttaaaaaaaaatggaatgcttctctcagccagaccacagcacataatgattcccactgttggatgaacactgttggatctgtcttatgaaaaacgctgttattacctactaactcatcaataggtcctggctctacagaatctgggtctcatcaccctcatccaccccctcttgtcctctattcacctccacttgggaacatggccacttggagaaggggaagctttccctctcttagcaacagctggggatgttgattcagtaccttacattttacactcgtagcagagtgcattcactttacaaaggatttttctacttgcgattaggaaaaaaaaacacctctttatttttggttctgtgagtagtttgtaacagtttcaatagcagcatcaattgtagctagtcggttggtcacaggaaagttcatagggtttttactacttttgaagtatccaatttgaaattagtccatagatttttaattcatttaaggaattaaagaacataatattaagatactaaaagaaatattaaattagaagtaaaaagcacagtgttgttactctaagttatttagactgtttcaatatgcattgctaatggtaacaatttagaaaaatacaagaaaagattatatgcaagactgtaatttttttgctttttattctttctttgttcttatgacctttcatgtatttgataacttttttacttctccccacttattcccacacacacacttacacagaatgaaaattaaaatcccaaagcaaactaaaattactgctagagaaagatggggaggaacagaggagaaacgagatagtcccaagagcaaaacacatgtagattgatgcacagcctcttcaaagattggaatctggatgtaaatccccaagtttgttgctagttagaacattttcatctaatatacaagttaaaaagagaacatatcttcatggaatacaagatgctggttctgttccaagatccataaaattaacacaaattaaagtaactatatcagacaaaatgtgttgtttcctttccttctaatatttacttagaaatgcagaggctacatgtacttaggctttttactctggccctcaagggatgggaggatctggctccaaccaccctttgtaactcattttatagcactcaacgcattgcagcctcattggtacctgtcatgttgctccttgtgcccagcttctcccatggctttatactgtttgcattgctggtgctctacctgaaatactcttcctgggtttacataatgactcctccttattctgcaggcctcggctaaggagtagacttaaaggttcttccctgacatgtatttaaggaagtttcccagagttattctctgccttattcatctgtttgttgccttaacaacactcattacaatctttaatcatttgattccttgtttacttacttattaactgatgaacatcatgtcttcaggaactggatgtcttattcattcctgcctttcctgcatcacatgaaatgttgagcacactgtgggtgaaatttttgttgaaaaccttaatcatagtttccacagtgtatccatatacagtgaagcctacttgcatctatctttcatttctagtcctgattttggactagctgtggttaggcaaagcatagccttcagttaccaggttggctttgagctcccaaatattcatcatatcttagatttcatgaattctacagctaacatcatttgctagccattttcttaatattttgggctgacttgattttagtggaaagcctagctatttgctgcttaatgttaggtttgttttattgctgtggctttattttaaagtatttatagaatataaatattagactcccttcaggaaattattattcagtaagagaaaaagaaagattttccaagttctcaaagaaaccatttccattaaaaacagtatgtttccccacataataataatggtggcgcaccaactgggctgtattcagcagctggtgaagacattcctctctgagactcttaggaattctgtcaacctctggtgtaggcacagactttcagattagatgttgatttagtaggataaaagatacagtagactctattatcctagctgttaaagttcaattaatgtatgtacttttgagtttgacgaaagaccaatagaatttgtatgtaggtgtgtgtgtgcatgcatgggcatgcatgcgtgcatatatatatgtatatacacacatatatgtgtgtgtgtatccatatacacatgcgcagacatacaaacacatatgtgcacatatttaaatatgtatatttaaatagcataggtgaattttaatttacttaatggttaaaacattggtatattaaaaccctaaaaccatcagatgataaacagtatttcaaaaatggcagggtctgtatatatttggacatataaacatgtggttctttcaataagttatcaataaaaaataataatgaataaacctgtattcacccaaatatcatagtttgataatccaaaaggagtgttgtatccaaataagtaattatatttattcagaaaatcttgtgttcatattttgctatctatacctaactttctcaagttgcctaaatggttgtggagacctagccattgtcggctctacttgcaagctttaacacatgaacaaatgagaaacactgactctgaatattttcttgggttgactgggcagaattttagagagacagccaaataattcaaatttttaacattagacttttcttaaagtgatcgttgccaccagaggaatcgggaaacatctcttaattttcaataaatgtaatattactccaaacttaaatgtgacttcgtactaatcaagtcccaagatatggtagaaatgtgttgtcctaatttaggcaagaaaaatcgccacattttctctaagggaatgaattactgaagtaaatgacacataagaaaaccattattacttcactttgaatgattgatttcataattaagcattcaaagtttatgtaatttgcaacatgatttctttgccagatattcataggcatagcccacttaaattgttatagatactttctgttaaacatttactactttaacatttttattattctttctttctggttgttttttttgtttgtttgtttgtttgtttttgtttttgtttttttttagacaaggtatctctctgtcatccaggctggagtgcaatggtacagtcttggctcactggagcctgggccttctgtgctcaaggatcctcccacctcagcctcctgagtagctgagaccacaggcatgtgtcaccgtgcccagctaattttttttttttttttggtagaaacagggttttgctgtgttgcccaggctagtctcaaactccttggctcaaggaaagtgctgggattacagttgtgagccactgtacctaacaacatatttatcattttttaaaaaaatagcttttttatatgtattgtgttcattccttcaataatcaaaaacactttattgagaacctattcaataaatagcttccttgaatagaaggtgggaattatctcaaattcctgaatctatagaggaaaaaagaagaagaaattatcaaaccatgagacctcttccctcaggaagcgtacagtcaatgtgagcacacttctaaaaagagaaggcatggaagaaaggacagatgtaaaaaaaactttgattatagaattcagttggtctcttctctctaccctgtctcttaaggccactgcatacagaaaaacaggcagtgaatgttgtgcagacaagtatgctttggagagattttatatatgatgtttttattgttgttaaaaataacttagatcaaatttgtgaatttattaatttttaattagattataaaatcattattacttttatgtatctggcacttcttttcaactcagtcaaacctgtcttattagtctaaagtctactaaaatttacatttctggaaattagctacaaataaatgatcatcagcagtaattggcagcatgcaataatggatttttttcacataacaacttacaatagatgttagtacatttgtaactgagctttagaagtgaattaacgtaaagcaaatgcttgaagcttgcatttaaattgtcacagaaacagaatttagttcccaatactgtattagttgatacatcataaacattgaaaacaagtagccaaaggttgtatattgaccaagtgttttggttccatttaaaattctgtattctggatattttatcaaagttgaattaactcttatgataatagcaagtctcttaggaatggttgcatcagttatgtatcacaagttaaaggttatcaaatagtaggaagccttcttaacagatagtgaaattgaagttttttactcagggaatgttgacagttcagacactgaaagtaggtttaagttatgtatcagtgtacaccctttttgtacaactaaccataataaacaagttaagaaataatagttccctctttcttaattctaaagatagacatattaatttcactgtgtatgtgacacatttttagtagaaagtcccaatttaaagtttccatgaattctgcccattttcccactcatatctacccccattacacatctaaagtttacttatatataaagatatagttaccagatatcaaagatctctattttcacctctgatctaaactcactatttttccagcaggctattcctttgagttcaagtttgaagtttcaaaataaatgattatgatagcttctacttacttgtatcataaggcaattaccacagttaatttagcttttgaatatgctctgaaagcaacagtgagtgacctagaaattcaaagtattgtttaaagctgcttataatacattttgttctcttaccaaatgtcccctattttgcatgatgtcttctttttctgtaatttttcagtagcttccccttgtttttttttttttcagacagagtctcactctgtcacccaggctggagtggaatggtgcaatctgcgctcactttaacctccaactcccaggctcaagcagttacggtagctgggattacagacgtgcaccaccacactgggctaatttttgtattgttagtagagacggagtttcaccatgttagccaggctggtctcaaactcctggcctcatgtgatcagcccaccttggcctcccaaaatgctgggattagaggcgtgagccaccgtgccaggcccagtagctcccatggcttttctaattaagtagccaccatcagagactcatgtgtgcatctccaacagccactccaaagtaagctccatctattaagcatcactctctggatatttcataaaatctgcaaaattaatgattccaagccaggtttatctttttaaacgtcagtattctatgcaccatgccctactctccaactgcaggcttttactcccctggtagcccctcccctctctattcactggctggacctagaaacccaccttttcaaatcctctttcttgttcagcctacatgccattggccactatatttggttggtaccacctcctaaatatccttgaaacatgcatcccttcctcactacattatattgcctctgccgtactttaagttatcatcagcctcttaccttgactactacattattcttctcctagtttgcatgcctgccacactgccagggaaatttcctttccaattcaaatcttaaatttcaatcactggtgtgattgaaacaccctatgtttacagaagaatttcattggcctatctcacaaaagtttctgtaatctagatctattttatacttccaatcttcttgttattccttatatcttcattccccactacttatgcaccagttgcatcaaactcatgccagtctccttcccagcttgggtcactgtagtgtttccttctctagccaaacatggccacttacatactcataaactccaactcattttctaagattaagttcaaacactgagattctgtgaaactttccctacctctccaccaacaacttcaaataatagtaggaaaatattgtttgaaaaaggtgatttagaaattcaaaatgaagttaatattgaatggggaataaaaagaaagacacatgagaaagtaaaattctattttctgtctcagaatcacaagattttatggctgaaagtgttgttacagtcaatatagaccaaagttttttgtggtttccatataaaaagtaaaatctcttgccttaaaatgaagtttgggaaatttgtacttagttgtgtaatactgactgtgtaatttgtatgatccttatacggcattcaagaaagctgtcactacactacataaccataaaaaaaatctagactcattgaatctgagcttcatagtcttcatttctctctcttcccacagccagcatttaaaccttcctgaagaaataaggtttgccatcatttgatattcaaaattcattgccatattcaaaattcactgattaaaacataaaattttattgcaagttgggacaactaggtctttcttgctttttcaaaaatcaaatttttaaaaacccttgcctaggaagtcattatatgaaaaaaaaaaggtaaaaagaattattgtagcacaatgttgactgtgctccatttcatcagtaaaagttttagagacagagggaatcaagcaaggtattttggcacatctcataatttcagtggatacagttacaatcatgagacttattcaaagctctctcctgaagaacattccaaacattcaaaacctagtttttaaaataaaatttatcttaaggaatgtcagtttttgaagctctgaatatgtaaatcatgtttatattaataattgatatatttaaaattatatcataattggcaaaagtttcagaatacataaaattagaattttgtgttttctttcagcagccacatttcagagatagggatggattggcatggaccaatatggtccatctttcttaaacccagagtctcttagtgccctgagtttgaagcacttttctttcaagttgaggtccactcttctatagacaattctatgaaaaggtcttacaagtttttatctacacctctcgcttcttgaaatggataatgatagattccaaacacatggaaatctcttgccccttttactttttaggatctttgcaagcttacaatatgtacacgttttctgtaagtcaccaatgctgagttactggcatgaaaaatgaccctgttacttggaaagtagtttcacttacaagtcccccaggccctgtaatgtctaaacctcctgtgccactttatgtgactaccccgcccccacagaggagcatgcacaggaaaagcagacttcccttcccccacacatttccttagtttatttacaaaacgtcttggaatgagaatgagctgcttgtggttcctgtggctgattcagggatggtttcctacaggcagaggatgctggtcaaccgaatgacctctctgtaactaacccgtgcacccctgtggtaaggctgtttggtcttataggtacctcttctaactaagcttggagggatttgtttttgtggtaaagaacttagtaataaccaaacgtcactgtaaagacagatttaataatgttaaggtccatcagagcctactccttctactaccaacaagagaagccagaaatacactgggatgcctttagattcctgtgcatcaatctttctttctctaaggattatggtttttttttcttctggcatcttcaaaggacaataaagctattagcaatatatttgagtggagaacacattaggaaaagaaatcatcctaaacaccagctatatgagaaacatccgttagtcagtagtttttaccagctcatgcagaggtgatgatgactatttaatagtcaaaagaagatttaaagttgtgatgatcttaagcaaacatgagtctcccaaatattcatttctgtttgttcagacttgctaatgaacactcttaactcacacactggtaactcttggaaaccctggaatatgtgtaacagtgattcttaaggtagactggtccattctcaccaaatatacatttcactcgagtaagtagaagataagggcacagaaactgtaagactccagttccaaaagagaaaatattgaacataaattaccataagtagtcatatatgatccacatggaaacactggtgagataagcatcacattttcaccattatatctatttgaactggcaattattaagctcgtgtgagaagaaatatttaatgaaggaattctggggagctcaacagctaacatagcttcagcatcagtttgcattggatcaaaaagtaaaattgtgttctctaatacaccatagttcaaaacagatataaaacttagtgtccttactcaagttaagccctaatgtacattattttacttactgaagaaattagaaacatatgcttatcctccattacataaatgaaaagcaaagcaaatgtgtattaatttcactgtgtaaatgagcacaaaattaccagtccccaatctcccagggtgctagttcagtgaggatattatatatatgaagagaatatatataattagttatacataatttaaaaatatatattatatgataaagagactatgtatacacacacatatataagtcctttgaggcagtatattctttatttttcaaatgctcaattttaagaactttgaaattaaaaacaatacatgtgctaaagggaaataaaagatcataaaaaaagataggaaaaaaaatcccacctcattcacccattaccaacaaattgaaagctaatgaaagagaacatatatcctgcccagaaaatgtcatttttttatctgtgatttaacctttgtaatgtctttctacatttgtctccacagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaagtaagtgcccacacgaaattgtatttttatctcatctttggtgacttttccagattgaaatggcctctaatatatttgtgatattcaatgttaagtaaatgataatgtttatctgataattaggctaaaccatacttggacttaaccctcagaaccagaaaatttttatcactaacttacaaaaaagcactcatgttttggttttctttttaattatgaaagcaaaggctgggaatatgattattgctcattgaacctatagaaaagtactgcaagcctcaattccatctgagtttccattatcaacacaaaatccaagtattgactaacttgccaaatcatttcagctattttgacttcaagagagattccagagcaactgaaacatttatttatcaattggaaataaatattgggagtactgtcatctggaacctgaaaacctgtttttcacactgcagacccagggacctttctcaaaaatgtaaattaggaaataccactctattcaaataccatatgtagttcctccaaactcatctcctacaactccccctcacccattttgcaccagcctcacttcccttctcataagatcttcccacctcaagcctttgcaattgtgttctacactggctgttctagcagttggaaagctttttgtccacatctttgcatagctggctgtcttatatcattgatgattttgctcatatgtcaccttctcagagagacattccatgatcatcctatccaaaataatcagcctgttccccttgtcaaccaccctccatctctttttcccaccatttgctgttgtttttttgttttgttttccagagcacttatcactctggaactagactgcctggtttcaaaaagcagtctgatctgttgtcctgggttagttttataacttttgtgagcctcagtttccttatatgtaaaatgaaattataccaatgactacctcattggattgttgtaaactttaaataacttaataatattgtaaagcattatagcaatcctggcttacagtaatcaccacataagggtgaactattgttattgtttactgtatctcctctcctaggatgtaaactttctgaagcctgactcttacccctcttgtgcattgctgtcaaccaatataaaaaacaatgcctggcacatagtaggcaatcaaatatttgttgtaagaatcaatagccctcaagaacaacacaaagataatatcctttgtatgttttcttaaggttctgatgaaacattttcactatcacttaatataaacagatacttcatcttataaatattcttggagatatatatatatatatatatacacacacacaaagattttttcatagggcaatcagtacaatgattttaaaatcaataaccaatgtacctcaactaaatcactgtggaggaatcgtgaattcagtctggcaaaataattttggacttcaggtgtttatttgatactaaagttgtgtgtggctgtgtctgacacatgtagaactggaccaatagttaagagaacataatgcaagcatatttctttcttttttctctttcagaatgcaaagctgactgtgatacctgtttcaacaaaaatttctgcacaaaatgtaaaagtggattttacttacaccttggaaagtgccttgacaattgcccagaagggttggaagccaacaaccatactatggagtgtgtcagtattggtaaggagaacctgtaataatttgagtaagtgataatgtcagtctccatggaggtgcttttcaaagtcctttgccaaaagaacttgaaggttcttgggctgagatctcttaaaggctgtctccatccttctttacaaagatactctcttaaaggtgtttttcataaccttatctagtatgtattatggtacaatttaatacagtaggtgcttccttatttcttagggactattgataatcgtttcaaccattctgtttatgatagatttatttttattatttagtgaatttttatttaattatttaatgaattttatttaagtaaacattcagccaagacacacatatgtatatctgacagtgatctgttatgtgacatacatatatgtcttgaacttaatttttaccttagagcaacagtttcataaaacacctaggtctaatctcaactaatgaccaaagttattttccaaggtgggaacatatattctcttgacacagcccattaatgctcagtaaatggatcaaagacctagagaactggaattgatttagttaaaatctcactctttttctctcatactgctatgctgaagtattctgcttgcacaggtattgatacataataaaaaggattgtggacttactcaaactgacagattgagacagtccctggggctgattaattgcaggccaaatttcctgaaggggaggtccctcagacaagttgtttgtctaagtaacagatcactgtcaggctgtattttcaatcttttaaacgttgtgcagctactacagctacaactttgatgaacacttgggaagcagatgctgaaccaaatggtaaaatagcctaggaaatctcaaaatcccctgggcaagaactacaggaacctttgatgctgcggtgatgttggcatatccacacaactgccctcctgattcagtacaagatagtctccaggactcccctggagtccccatcttaggggtcccttagaatctaaagggctggagtaataactctaaagtgatggtttaaccatttcaagtgtaccgtagcacttttatttctaaacaatgttcttgatagaataaaataaatagatattttaaagataattttagaagcatctggaaaacaacagtcttgaaacagttcgtggctcattttggttaagtttttcttctctagttgtaaaaacacatggaaaaaaaagcaacttaggaatagggtaaaaagtacaaaagaaagcacttcaagttctttttcttataggtcctgagggctgatgattagaggtaataagttccaaacactggaaaaaatagaaaacacgtctgtggaatattcaagagcagaaattcaggatgagttgcagaatgtttgtgacatttctctacccagaaaaaaggcacatatttagattttttcagttgttgaaggtgtaacattcagtcctggaaaggctatttaccttaaatgtattaatgcttttctgtcagggagatcatttcacacttggcactattggatttgcctttaaagcttactggtaatttatgctgctagtaagactaagactatttatttcttaacacaactacatttaagtttatatattttggaaaagaggttagcagtccaaaggccaattactgagtttggttcatttaacagatgcaaatgacctaggacactgtagtaacacaaatcaccaactttcattcagggctggctccggttgtttgctcaataagagatgtctcccatcatatggcgcctagcctgcaggtactacacctgccatgcctttaggccagtccagaatttcagggaagatgatgacctgcttctatatcacaaaggaatattaaagcctgttcctttaacaaatatgaaaactaggatccggagagccaaaatggtgatcccaaagaaacattttaagttattttcagtgctgtaattagtagcctgactttagcttcccactactcatccaatagaaagaatgtgtctttctcattgctaaaatccacaccgtatttctacttttctatcgagattttaaattgagaggaaaggtcataaacagaggaaatgctaccctgatatagagctgggatgaaagaggtatgtcacagtgtatctgctttccatggtttgcaggtgaaatgaaacagaaacatccactgaaccaaattttataagagaacatattcttttcactttgtgctccagatatttgcttcctttctgcactgtcattttgtcaccctcactgcttctcttagttggatttgttcaagaaacacagagagaatatatctcacttcaaggactgagtagcaagggacattcccttgctatgttctctatggaaccatgcaactagtcaacaagaattagagcaaaatgaccagtaaagtcactactaataggacatcctattcaactttcttgccaattcgggaatcccttttacagcatcttgcactgatgatcaaccacagcacaatcattcccagggaccggagctcattacctttatgagacatgtgcttcatttgcttcattagtgaatagctaaagatttccagttttaagatggttcttaatacagaagctaggaggaacacagaaggtgaatattctgtttttccttaactatctcttaaccaaggagtgcctcaattctacattgttcattaaatgatctgaatagaacctaaatcacctttgtgttgtctttagcacttttttttttcagttttcattttttttagtggaaatattatttggatgctaacattataggtttattctacagtgtttctctaagataaattcacctcatttcatggtgttttaactctctggtctcattagaactttttactacctaaactcattagttttgaatattttccctcctccaatgaaactatctaaggttgtccgtagaatttaatttataaaacctttcatcttctgactataaactaataattacctaagctgtaattttttaaatacgtttttctaatgtccaagtgtacatttgcttagaccacttttgctattatgaaagagcaccgaagttctggtcacttgcacatcagatcattttttctaattcagtcctcttaattctggaattaaatgaatactggacaaagtgacagctcacaaacatagactttcctcttctcatttgcttttttggaggtgcctttttttgtaatcctaaggatacactactttttaatgattaatatcagaatgggatgctggaagataatatccataaccagcaagagattataatattattaattgacttagttactctattcttgaatgaaaattgtagtggtataactgagcatgaagactattttaaaatggttcaataaagttcatttcatttcacagaaacataaagtcatgtatttaatcaattccatttaattccgtgttgcactcagggacctgaaagtgtctgaaaagtcctgtgaaaaatgtataataaatggatttaaatttctaaaacatttaagttatctttcagcctctgctgttatgagatagcattctgctctaaagtaaggaatcattaaatcagaaggcaataagggaggttactggaaacttctttttgtggaaagatagtcttaaatcatctgaaagagttactgttgctagctgttgttatacattagaaagttttagggacataaatataatagcaccttgagatgtttcttttctttagaagttcaaaaatctgttacaacctgagaaagccgttattgaaaaaaagaaactaatacagaaaaaggaaacaaatctccaaaagaagcttcagaaaaagtacatcaggtcatcttaggaatcacttggtcaggttaattttagaagcaggttatcagctgaaattgacccagaattcacatataatagatgccgctatgcctgaaccatactcagtaacagatatcaatatttaagcgtacaacagcacatgtcgtaagcaaaggcagtaaatagtaggccaaagacctggattcattttctgctcaagcattctctaacacagaggttctcaaaaggagttcccagtacctgcaaatcagcattacctgtattgttaggcaaattcacagccctgccccagataactgaatcagaaactctggtgggggctaatggagaaaggtccagaattttttgttttagcaagccctccaagtgattctgatgcatgctaaagtttgagaatcaattctctagcacatagtataacaactgttcttcaaattctggtcaggatcaatcaacaattgcagcagtgctctggaaattataaagaattgatcaattttagtgattatattaatgttagtgcctgtgttaatcaatctagagaaaaaggaaatccaatgcaaaaatgagtttacctgataatgagtactaaactgaaaacattcaatttctgcctttcccattctcctgttttatatttaagtcatcttgcccgactttgatctgcaagattcttctcaaatgtgggcaagttctgatggaagcaaatctttttttaactcaacaatagtgaaagtggttgtaagccagctgagtctgtttcttctgttctgtttcagtgcactgtgaggtcagtgaatggaatccttggagtccatgcacgaagaagggaaaaacatgtggcttcaaaagagggactgaaacacgggtccgagaaataatacagcatccttcagcaaagggtaacctgtgtcccccaacaaatgagacaagaaagtgtacagtgcaaaggaagaagtgtcagaagggagaacgaggtacaatcataataacaaaatgtgcttgtttgaatcctcataatctgttgcatttttcattttatttcttatgaaacacttggcattatctttcatgcctaatatcctaaaatgtgtaccaagcaagaatatgctgcttgtaaattacagaatatagatgtggtaattccaaaatatggagcctgatgtcagaactttactatagaagtgtgctaattgaattatgatgaactaggctgtattgtaagcattcagggcattatctgtactataatctgctttgctagtacttagaaaacttttgggaagtctcataattacaaagtctaatgatatttacaagaacaagacaaagaaacaccgccatcaaacattcctttcctcactgcctgcaaaccaaagtagtgaaatgtagtggtaagcttttgtagctaagtgtatatatatatatatacacacacacacacatatatataaaattaaagacagaatatcattctgtcatccaggctgtattgtagtggtgccatcgcagttcactgcaacctcaaactcccaggctcaagcaatcatcccacctcagcctcccaaaatgctgggattacaagcgtgagccgccatacctggccagtatagttaatactgactttattttgaaatgaccaagaccacattttatgaatatagcaaaatcattaacgacatttgtctccagatttcttttcatattgcatatttcttttcatatttcttttcatatctgtctccagatatcttttcatattgatttcttttcatattctggtctttatagaccagattacagaacctattccatcaatattaactattagaatttgctgtgaaatcaacaaggagaaatatagcatttaataatatgatcctttagggtgaataaacttccagccagaagaccctcagttgccgatctttaaaatatcatttttctatctttctcactaatgtattcagcaccacttcctacaaatatgttgtgtagttttatgtaactattggtagttatctggtgagtctataaatgatcttctcaattaattccaaaggagtttgattgcctctgtagttgacctttcttatttctccatagttgacctttattaggttatttcattcatttactagcttatttcattcatttattcattcaacatagttttattatattcttactttatggctatgcactgtactagggcctaaggattcacaactgaatggggtactgtctctctattgtgaaggtacaccagagtccagtgaaaggttgagatgtttaaacagataatcacaacatcgtagaataagggagattatagatgtgtgaactagtttaaagggaacacagaagaggacactgcaaacttgaacattgcttatacaaaagagaatttgggtcacctgtactttgcaaagaaacatccattatgccaaaagaattggccatcactaaaagctataaaacctgtttctgccattctaatcaagtagttaatgtgaaaaaattcttgaagacatgggttatttaaagagaacttcaaacttttgtaaatttgtaggaggttttgattaaaacttagtttaaggaatgaaagctggctagtgaaaaaggccttttggcatttgttaccaattaatttaaaacatcttagattttaaaagttggatttggaagtcaaatatttcatcactctacttgttggtatgctcctgttgccgtacatttacttatgtttactaaatttccttaaaatttaatgacttacaggtggtctttgctcatatcattcttttcacaaagattgtacgttattaatcagtattcagtacacattccttttaaaatataaatgaagaaaagttatccaatagcagaattaaatcacgattctaattacattttatttcttttacttgagaatgtgatctttcaatagattatattttggtagcacttgacttaaacattgaaaatgtcaactgttaaaactggcatttatctcatctagaaagagataaaataaacaacatcacaagaagtttgaaatagtaacctgtgacataagatttagcttaaaagtgtctttctgatttgttttcttcccctctgaggatacagtgacattttacatttacaaagagaagtttatacaactagaaaatgtaggtgttttattttttcaaatttcataaaatgtagactaacaagtggcaaatatgaatcacatttacaattaatttccagatttagtcctacttttattttttttcatttatttttcaaggtgtttgtcaaaaacttttcttaagtagcctataaactacaggtaggaagaaaatcatttctctctttgttatttctctaatcctccagttttcttaacttctcttaaggtttagttagcaagtatcctatttgaacacaaaccaaatagaaaagtaatagtgacctctggacatcccaccgtatcctctctatcaagcatcatatcaaaataataacatccagagtcttcatttaggctctactgtatatttatataatatgtataatatataataaaaatatcttgaaaattactcattgtcttgaatttataacctaaatgataagaaccccacatacacatatagagaagcatatcaacagagcaaatttagtagaggactttatctttatatttttctataaaagttggcatttcttattttaagtagggtaagcattagaaacatttaatcaactttaaagataaacacaataaagtggtacagacatgacttcccctcacacttaggatagctattatttgagttgctcccagatgtttatggattaataaaataagaagattcctttaggttcacagcttgagcatttcaagatgagtgtactaaaagataaggcttttcttatgaatttaaagttaggtctatgatccctgcctaagaggttaacaatagacagaggtagataactcatatttggaaaaggtagggagcatgtgttcaggattttttctgctctgttgaaattgccaaaggcaagatctccagggaagaatgataagatccagaaatgacttttcaaaatgtacacaaagaagaagttgaatagaagaaaatagtttgtaggaacagagtggattcatctagttgggagatgctttttaatatgtatatgttacaaaatcttacacacacacatttttctttactaccattttctcatggttagaataagttaacccaaggagataaatttaattgttgtatccttacatttaaattatctcatgtatttgtttacagtatttcagattattcccctttacttgacatgctaccttttaatcagcctgaacttctccatcaattactaactttagtaagaggtcattaccaatacaattctttctagcttgaacttaattgaattatatatttgaaatatcaaaaatatagattttaagagattatacagactaatatataaactattatcacatgtgtattgaaacatcatatttaagtagaagtaaacaaggagaaaatgcatttccagtggttgccaggttttatttattgacttttttgacatacagtgtataaccatctcagataaggaaaactgaaacagctcaggaagatgtgtgtgcacctgcatttgatgcaaaagggtatatttgtgtatgtggtggtggaagcagagtcaacaaacacatttttcattcatttgtaccttcctctaattaactaaagagaatttcctatagatggtttttaaggcaactcaccaagaataaaagaaattttgttctttggttagttttacaaaaaagattcttattaatcacagatagtgtatgatcttgggatagaaaggagagagaagagcagagcatgttgctggaagaagtgaggtggaggtctatcttcctggtataaagacaagctagcattcattccaccagagaaatataaaaggaaccctttaaaatagaaagaaataaaatgtttagggacactccagggaagaaacaaatgtgggaatcattgtattactgtactatttgagtatactgtaggttgccttatgtactttctcaaaattaagtatagtaaaagtctaccaggcattatataaaggcattacatacattctccttttttttttttttttttttttgagatggggtctcactctgtcgcccaggctggagtgcagtggcgcgatctcggctcactgcaacctctgcctcctgagttcaagcgattctcctgtctcagtctcctgagtagctgggattacaggcacacgctgccacacctggctaattttttgtattttagtagacacggggtttcactgtgttggccaggctggtctcgaactcctgagctcaggcaatccaactgcctcagcctcccgaagtgctgggattacaggcatgagccaccatgcctggctgaatgtattctctcttaaaggctaagccacgttttcaatttaatgtcctcagtggacaggacttccagttgctgaatcactatttagctttccctccactaaaattaattatatggctataatcatttctttttcataatactctcctatctattcagttgaactgtttgcaaccgccttttttgtaggtcgtaaatggtcaaatgtaagcagtttcatatggttcaacctgatactttaaaatttcatctctctaaactgatcaagttttagaaccagacctacagtatgtttcttatggattgacagtttacaatttgtatatactacaatctgttttaaatattaagcttttaataatagtaaactgtacagctgtccttgaaagaatgtaggcactaccaatgcagtgaagaggaccctgaaaagtggggcttaggctgggagggttcttggcttagcccagaaaagaattcaagggtaagccagtggtgttcaacagcaacttttattgaagcagcagtgtacagcagcagcagaggtactgctccttatggagcagggataccccataggcattgtgccctgagtaccatctcagaggaagttctgcagtcacatttatacccacttttaattagatgcaaattaaggggcacattatgcagaaatttctaggagaagggtggtaacttctacgtcattgggttgttgctatggaaaggggtggtaacttctgggtgttgccatggcaatggcaaactgacatggcacattggtgggtgtgtcttttagaaaggtgcttccactccatgcctgttttaattagtcctcaatttggtctggtgtctgaaccctgcctccagagtcaagtctcactttgtgagtcaagccctacctcctacctcactactcatctttaaagtctctcataaaaacatgtttggtcttcagatgctctttaatcatggtcacatatgacttattctctgtttttatttgatatttttttctccttagctatattactcaacccttattccttttttttttctttcccaccacctccaatttaatcactgaaacatcaaatcaccttgtaaattcagtggacaagtatcagaatttattatccatgtaggtgaaaacatttaatgcctcagtgataggccccacctcttattgtttcctctggcattgacattataatagcaggatctatgtgaggattctttgttgcctaggtttttgggttgaagacatgcacaattgactcccctgtgtcataatgaagcagcagaattacagccagcaccttgatagatatagaaaaaaaaatgaaatgacagtttttaagtttcttgcctctaacacattttacatcctattgtatgttcttaaacttctcaatattaaagaaaaagctctgcagaaaataagactttatttcatgccttgcattccttgatattatatcattttttagaactcagccagcagttactacctcttacaattcagaccaagtttgctccataccatttttgtaggctctctgagattttggggattttattaacggtggtcgaaaatcatggtggacattattcacagtgggaaatacttaattgttattatcatccatgcaatcccttcattcctatgatagtataagaattatttgtaggcttttctgctaattggtgtgtacctcagcattcctattctaaaataaactttgtaataaatgacccttgaaaatgcctatattctctgagatttcacttagtgatatttataaatatttagtgctttgtgacccattggtgagtgtgacataatacacagtgatcaggttattgaatagagtggtagcattcttcagctcctaagcaaacaatgatcttgccattgtttaggtctggtgcacgaggattgtttcagttagcttttgctgcataacaaataacctcaaaacataaaggcttaaaacaacaaccacttacttaacaatttgtggctgggcaattaaggctgagacctactgggcaattttgatcttggctgggctctgtcacattgttggatggctggagaatgaggaaattgccatgtttctattatcatcaagatggcaagaggtcctacagccttccaaagtagaaaaggtgaagtcattcctcttgaggctaggctcagaacctggcatagtttttacttccaccacattctgtcagcctatactagtcataagcctagtcctgattcaagagttgaagaaacagattttatctcttggcaggagaaggtgcaaacttactttgcaaggtggcatgcatatacagggtgggagaggagaattatagccatttttgcattctaccctagaggtctttctcttgtttgtagttagattagtgtgattcctcattcacttaacaatctcttattgtctgaaatacagtaagagatttgtatttcctttgtaaatttccttccttcctttgtaaaaacagtcaactattgatacaggagatgttgtgttggatattatttctattgtactttctaatttgtaaagggcagaacaggaagaataaataaaatctgaggccaagataccttcatacgctcaacaaatatttattaaacttccaccatgtgctgggcactcttaggtgctgaggataaagcagtacaccaaaaagacaaaattcttttcatcatagatcttatattccgaatggtttatatcagtccacaaggtaatgaccatagagtatcagcccttttgtaagcatacacctttgttaacagttttcacctttgtgatttgtaccaccagtagctgctgtcttcattagagtttcctaacacattacaaagacatttgttaatgctggcaaaaatgaaacttctctgcttacatttcattttggtctcaatgtgaatacatgtattttttctgtgaccaccatgttgatgtgctaatatgtttttgtaagacggctaagtagggttaaaggtacagcttgtggttgtggaacaatgctgagttaaccggccctttggagaaatgaccccaagaccttggcttcctttacagcctgttctagccaactgagatccctgccaattaggagggttccctagagagagactccgagagcatcagcataaatttaaattctggacccccaaatgtagtttccaaaagaagcttcttgtcctttgctaattgcaaagtaaatatttctccagcaaaaagacactccctcctttcatgctcctgttctccttcccatctccctaatacagtcactccttaaaactgctagtgttgccgaaacctctttgacataggggacaccccacatttgaaggcacaaagaattattctttccatagataattatcttgctttttatatcctccagcagcttcttcatagaagcattacagactaactttgtagatgtcatagtctgcagaaaggagttgatgccttatccttgggcctctcaagaggtgtgagtaagtaggctattattagcatgacaaaatgtatagaaatgaaaattcttcaaaacctcttaatccactttgttctcactctcttctacatgcccttctctttctatttaatttcctactcagttccttacctttcatttaaaacatcccatttctcaggtcccaaattagaaatactttcctaaaatttttctgtttttcagtttctctaaaaaattatttacgacatacttattactttaatagcaaaataatatattagcatgttatctctcaatgatagtcctttttcaccaagctcactgttctgccctctgtattctgcaggacattgtagttgaaaatgacagatctcaaattatcttaggcaagaagaaaattattggcttaaacgcagactgcactaagtcctcaaacaatatcactttatcacaatatcactgcatcgccttctgctctctccctttctcaccatttcagctcacactgccttcattcctcattgtttgtcggccttattctcctctgctgcagagtctttctccatttaggaggaaagctggctctgggcagctccaagtctatatatccacattgctccaaataaaaaaggatagtgctctcgctctctctttcagtatccctgcatccaatctcacgaaaggattccaatggaccctactttgaatcactgtggcagaggaattggggtcctgagattggtctgtgtaagtaaaatgcctgcagttgaagccagggtcaagtgagccattttgattgctggctctgtttagaaaacaagggtactgacaaaaacacaacagatgtaaatcatctcccatctctccccaccaaacaagaaacaaaacttaccaaatctagaaacgtatgtttttctacaagataatcccttttcaatactggttttgaaaataattttaagtgaggaagagtaaccaaagttttttctgtctatttcagactaaacacacgttcaggataatgctaagaatattttaactatttttttctagtttctctgcatttgctagaaactttttttttgggagtaaactggctttaaatgaatagaaaaaataatctactatgcatatgaatggtttctggaattgaattgtgcaggcttaagtaaagacatgtccatgtccatttctagctgctgagggttctgtgtgaaatgcaccagtgtgggcaatgaccttttgcttgattatgcacaaggccactgaaacgttaaaattaactctaacctaattactgaactgcggtgtttatattgtgtatacaccaccaggtcataactctagcctctgtgagccccagctgccataattgagaaatatgccttgcaaatggttgttttgtttacttgttttttctgctggaagagcttgcttttcctatttttgcaaagaaacagatgtagggaagagtttctgaataaagtttaattacattttatatctcaatgcaaaacatgtacatctgtaagtgagatattccttttacttttgcgttacataaaatgtaatatctgaaagcacaatgccacttactattcacttttttgagtaatagcacattttaggtaaggaaatatcaatatactaaattcacatgcagaaaatatgaatagttgctaattccaaaaataaaagatatagaaaatatgtgcatacttaggatcaagagttaatatctaattaattataactcatgaacaaaaattattgtcttcacagaaataagaacctaggttttcataatgtaattagtagaatacaatttagatggctaattatttcttatggaatatgtacatatgatagtaaaatatttctcagaataataagtacaattgtaaacatctgctatgctgcttatctgttttccagccaacagcaaaatcatgaagggattttgttttatttcaaatttggtttgtctcaacagctaagatacagttaccaaagtatttcattggcaaacctgtagtggcttcacatttgtctagtttgtcaaggtcttgaaatgtataagacaagggagtttttaaatttaacttctctccatcagtcccttggctttctaccatgttttataccttttatgcccttcctcctaccttgtcaccctttccttccatctcagcagatttcttcaattttgaattaaaattatctgctcatagaataactgtttcttctcatgttcatcatcttcaaaaactaatatttaatatttgcagtgtcagcctagtgaactaagaaagtattgaaatagtttaaaaaccagaaccatctcagttaagctacagatttgttatttgttttattcatttctttgtttggcttacacaaaagctgtatttttaatatcaataatgatgtgcatgctcttgtaaaaacacaaaagcctaaaagatacataaataaaaaattaataatctcactctccctcagtccagtccttcctctgagaaaagcaatgtgaaagtgggttgtatattcttccacattaatcttctgcttatagaaatagacatataaaaaatttccatagagaatgaatatattattttctttataaaaagcatttgacttttctttctgtgtctacagaaaaagaataaattgtgcaccttagtagctcaatagtgtgtgcatgtttacttgtgtcattttaaaatttgcatatcatggacgtctttctaattcatctttttaatagctgcaaaatgttacatgctatgaatatcacataatgtattcaaccattctgctattgatggattgtaaaattgtttcccatttttttgctcttcttactgtaacaaaaatctctatcatgttaatgaattgatacattgactttctatcagaggaaaaggaggtgatgcatcttagaatttagagcacaggctttggaaccatgtggtttcaaatttcagttgtgctttttaactatcgctatgactttaagcaaattctttagcctttacatatcccatttttcctcatctgtacaatggggatgataacactaactacattacaaagttgtagtgaggagttatgagtatgtataaaactttcagacttgtgcctggcacagagtaagcactcaataattgtgagatctaatattaaatgtagtctcaaacatttgatggataaaccaaagatgtgaatattttaaatattaatatattctgccagattatttttcaaaaaggtgtttcagttcacacgtggaatatatcaaaattacgtgtttcctcatatcctgactctaactgcatgttattagtcctttaaactcttgccaatctgattgacaaatggtattctattgttttattgacattttcctattaataaggctaatctcatgtttagagcctatttgaatttccacaggatgcctatttatatgttttatccaattttctaatttttctattaagtaaaacaccacttaataggaattatttgtatattagagattaaccttttgtcatgtgcatagcaaatatttttcttattctagtattaacttgactataatgtgttttgcttttctttttttatattactgatatacttgaattagtttatttttttccctcaacttttattttaagttccggggtacatgtgcaggatgtgcaggtttgttacataggtaaacatgtgccatggtggtttgctgcacagatcgtcccatcacctattaagcccagcatccattaattattcttcctgatgctctcccttcccctggccccaacaggtaccagtgtgtgttgttttccctcgtgtgtccatgcgttctcatcgttcagctcccatttgtgagaacatgcagtgttttgttttctggtcctgtgttagtttgctgaggataacagcttccacatccattcatatccctgtaaaggacatgatccgattcccttttatggctgcataatattccatggtgtatatgtgccacattttcttaatccagtctatcattgatcaccatttgggttgattccatgtctatgctattgtgactagtgctgcagtgaacatatgaatgcatgtagctttataatagaatgattttttttattattatactttaagttctagggtacatgtgcacaacatgcaggtttgttacatatgtatacatgtgccatgttggtgtgctgcacccattaactcgtcatttacattaggtttatctcctaatgctatccctcccccatccccccatcccacaacaggccccggtgtgtgatgttccccttccagtgtccaagtgttctcattgttcaattcccacctatgagtgagaacatgcggtgtttggttttttgtcctcatgatagtttgctgagaatgatggtttccagcttcatccatgtccctacaaaggacatgaactcatccttttttatggctgcatagtattccatggtgtatatgtgccacattttcttaatccagtctgtcattattgggttggttccaagtctttgcaattgtgaatagtgctgcaataaacatacatgtgaatatgtctttatagcagcatgatgtataatcctttgggtatatacccagtaatgggatggctgggtcaaatggtatttctagttctagatccttgaggaatcgccacactgtcttccagaatggttgaactagtttacagtcccaccaacagtgtaaaagtgttcctatttctccacatcctctccagcacctgttgtttcctgacttattaatgatcaccattctaactggtgtgagatggtttctcattgtggttttgatttgcatttctctgatggccagtgatgatgagcatttttttcatgtgtctgttggcgcataaatgtcttctttttagaagtgtctgttatatcttttgcccactttttgatggggttgtttgactttttcttgtaaatttatttatgttctttgtacattctggatattagccctttttcaaatgggtagattgcaaaaattttctcccattctgtaggttattcactctgatggtagtttcttttgctgtgcagaagctctttagtttaattagatcccatttgtcaattttggggtttgttgccattgcttttggtgttttagacatgaagtccttgcccatgcctatgtcctgaatggtattgcctaggttttcttctagggtttttatggttttaggtctgacatttaagtctttaatccatcttgaattaatttttgtataaggtgtaagaaagggatccagtttcagctttctacatatggctagccagttttcccagcaccatttattaaatagggaatcctttccccatttcttgtttttgtcaggtttttcaaagatcagatggttatagatgtgtggtattatttctgagggctctgttctgttccattggtctatatctctgttttggtacgaggaccatgctgttttggttactgtagccttgtagtatagtttgaagtcaggtagcatgatgtatattcctttgtgtatttacccagtaatgggattgctgggtcaaatggtatttctgcctttagatctttgaggaatcgccacacttacttccacaatggttgaactaatttaccctcccaccaaccatgtagaagtgtttctttttctccacaacctcaccagcatctgggttttttttttctgtttggttttttgttttattttgctttgtttttgtaattacaacttctccttctcagatgctgattttaataaaaattgttagatactgcaatcttacatgtgtgggtattcattcacaaacattataggtgacagttgtgtgccagacatagtgctaggcacactagggtaaatatatttgcatgtacatatgatcataggtatgtataagctatcttgtcctatatccctcctaaactcttctgcctgtgctgatgtaattaagaagacttatgttagaactaattctagatttcttcctcttatgtaggaataacaaaacataaaacatcagaataagtcaaaaagtaccttggagatgcatacttcaccattcttttttgcaataaacaacacgaaagagttaaagtgactttgcagaagtgacattatcacaaagctggtaatgacagaaaagaaatgtgaatcccagtgcattatagtttccactgtatcataaggctttatggacacaatattttgtgaagtattgtttaccatgaactgtgttgacggtgttaattcaatttgtggagctatccacatatttaataatatatcaccatactaactgtgcttacttgcttcttttgttttttttaatcacttcttagggtcttatttttaagcagcaaggggagccacctacttgagccactctcccctgctgcaatggaaaacagtctcccttcaataaaatggctattctagcactttgttctcactgtctgatgtggcttggggccaggtattctgtaaagcagatttgagcattagactaagagagttatcctcagaaaggtgttctgagaaggtctgccaaaaaagttgaggcttaaaaaaaaatgtaagtaggagtaggaagaggagacttttagtgggcatttgactgggtcttgctttcctcctggtaatagattgcttggctatctacagatgcttacaagatgagaaaattggagtagaaaaaaattgttttaaaatggattttagcaacagaaccctctgctctgttgaaattgcatgtagagcccaatttatacaatggataaaaaatagatgtgccttattgttggcaaagatgtgggaaaagttggaactatcatgcactattgatgggaatgtaaaatagtacagccagccactatgaaaacagcatggtggttccacacatacacacacacacacacacaaatatacatatatatataaagttatacatatatatataattaccatataatccagcaatttcatttgagcgtatacccaaatgaattgaaaatagaatctcaaagagatagttttacacccatgttcatagcagcattatttacaatagctaaaagttggggtggcagcaactacagtgttcattgatggatgaatagattaaacaaattgtgatatatacatacaatgagatattattgtctttaagaaggaagaaaattctaactcacgccacagcatagataaaccttaaagactttatactaagtaacttcaaagagttacaaaatggcaaatactatatgattttacttatatgaagtacctaaagtagcaagttaatagaataaaaagtaaaatgatagttgccaggaggtaaggaaggctaaatggtgagtgattatttaatggatacagacttttcaaattttggaagatgaaaagagttctgaagatggatgctggtgatggctatacaacagtgtgaatgtacttaatgccactgaactgtacacttaaaaatggttaaggtagttatgtgttttttaccccaatttaaaataaaataaaaataaactaagtgcctctattgaagtaaggtctagccaaccagtagctctataccaaagtactgtattttaaaactgttgaacaagatgttttctaaaacctcttttatatttttcagttataatcatggtaaaatctgtatttgacattcctgtggactttttgccacagaaaagcacagtatttttttcttaggaaaattgcttgactctcagaaggaaaaatatatcagtgtgctccccaaggcattgtgcagaggttatatcagatgtcttggagtccattatgctgtagctgtaggatgttgtagggtagcaagaaataagtaactttgagaagtggctctcatgatatactaacatgctgggctttgtatttctttctttctaggttttctcctcaagtttgcattcatttatactaacttatagaaacatcccttccacatttgtcattatgactatagtaaaactatggaaaacaaagatgaaactgtaacattcctaaaacatatactgtatacataacctttagcttgttgtaatgtttaacacacgacactgtatcactttaaacaacatctcttcctcttatttgtcccatctaatcctctggcataatgtttttttcaggatttctgtcatttatccttcctctttttgattgctaaatacataatctaaaatgttaggttgcaaactagcttcaaattggctaggagcttgggagaactactctgaaaactttttatataaactctaaggaggtcaaattcagaaaaatctcagctgctggacttggatcccattaaccactgatcatttataattaatattaataaatggcagatgacacatgtatattgcttaactaaaaatgtgtgtgtagtattaaattttttaaaagttagttaagacccagaggacctgaatgtatgtattggaataatgaaaagaacaaaactaccaacatgtgatctagtatcttctaactacaagcacctaaagttccagaggaaacagaagtacttttaattcatcatattacatattgtattgccatgaaactctatacactgaaatgcctgtttcacaagcctatattaatctggacaattggcttattaatcattatagatatacagatataaatatatatatataatatatacacaaacacactcacacatacagacacctgttaatttcctagtctaaaaccaaattgtttaatacatatggtttttataatcagaaattaaaaaaaatatccaaatgctgagttgctttaaatcctaatgttccatagagccccactaaataatataacagctggaagggatttattcatctctggacactaaggagttagggcacagtagttcagttacctggttatataaatctgggaacctatacaatgattaaaatggaaatgagacctccagttactgcaatgaaggtaaatggttttccaggggaattacacttggactcaaaatcaccttacaaaaagccaaaagacagaaacatgtattcgcttgggctatatgtccttattcaaccatatccattaccataaccatattaacatagattctttctgattggactgtgatttaataataatattatttgtttaaatgttggcaattttacataattatctcatttaaaattctttaaatattgcaggcatatatgcattattattatcgactgcattttaaagatgaggaaattgaggctttgagtgtgagtagtagatttcacactcaaagaccaggactcacactcagacctaattctgagtccagtgatatttcaagtatttgaggctgaaaagagtatataactaccttaagaatgtcagttaataagcaagttagtcagtactagaacctaaatcttttgtcaatctgatctttccattctgtctttttcaacacttttgccctgtgttcaagaggatcatttatttctaatcatctgctcttttctaactatacttatcacacatgaggcttagcatcaaccattatttcttattaatgatattatcattgttgaaaaaattgaaaacctctttttaccaccaaatctgcttcatctttctgtttacaaccattttgttattcaaataacaaacttaactataataagcaaattggccagtgatttccccttttgcttcaaatcattctgatgttttaaagccaaatagttttcacaaattgccaacattgtattcaaatgcactaaatggttatgttagtgctatcatgttgtctaaacaaaggcgctgtcagtcagtagagtcagtgaccttcaggctgttaagtggtttgtgcaattttcacaggattatgcttaaatataaatcctaataaagaatctcacttggctttttaaaaggttgttaaaattaatacttaatccaattcctataaaataatattgaagacataaagtaaaatttactaaaaaaaatgtatttcaaaggcttggattttctactcaatttatgaagcatatatggtctcctaaatgctgtgtgaatcattggacatgccagacatgaagcaaacttcccaccccaggaggcttctcagcctgaagcaagctgtaagtgggtagagttccaagagggaacacaacgtgcatgtgcgaggaaagcagatgcagcatgactttgggtttgttctttgggaacacacaactatatggaaaaatacatgctgctcccaattgctgtagacatctgctgaaggcacgtgagattgagactagggaatggtacagaatttctcctagaatattgtagtttaactttggaagcaaggggaattggctgttaaccgaataagagtttcattctaacatgaaaattgtacagcgtgctcattcgtgtgggcgcacagagggcgttaagctatttctttataaaaatatgggaacattgatttcctttagcagtattatttgatatctatttacagtttagttgggttgtcaaacatcagtgcatttctaataatgtgtgtttgtgataccttgctcgtggcaaaggcttaaaaatttaaagaggctttgaaatactttttaggcatgaaattgagctcacaaaataagcttaatggcaaattagtcaggaacacatggatatgtttcctttaatttgtatacagattttcagaattaagatgtggtaaaacctactagcagtctattaagccttctaaggcacttgcaacataattagagatttgcaaattcaaggttggcctaatagaaaaacgaacaaatttgtgtttgcattttagcattgcctgagtatttttacaaacacttcatttagcataattttgaaatggtggatatgttctgatcagaggactaagcagtatgaagaaagcaaaagaaacatgtttttaaaatcagggtaatagatacattaagaaactgcttctgtgctagcttttattttgttaccattgtcctatgggaagatgaggactataatttttcaagttgacctccctgccaccatattctctagagccactagaatggaactagtcttactctgttttcctcaaagatttaagtgtatgtgtgctacacaattatttaacacttcaataataaaataattgaaagtaattgtatggagtcatagaactgaacatagtcaccaacacatttttttaaagtattttatggtctatttgtgtttcttttcagtgatataagagattttcatttgaagtacccatgaaagttttcttagggcagttcaaagggaagtctgacagaaagagtgtttaggttgatgaagaagctttctacccttgggcagctttatcttaaactttaaactaaccatggaatcatatgagtgaggaactcttagacttctttcatttatatccctgactttaagcatagatgcatgaaaatttatttgattttaagacttcttagtgaatggattttcaaccttacttcaatgcaaaaacgtgattttccccagcttatcaaaagctttcaatgctcattctctttacattcaataattcatttgtctcctaatgtatacattttcccaaattaaaaatattcatttatattttttcctgtatttgcccttttgtctgtcttaagttggcccatttgttttattttggttatttgtctaacttagaaaatagaattcctttattgaatataaagtcccaaagcatgttacttagtttgtgtttcaatattcagcatcttgcggaatattgaaaaccagtaagtaaaagctttgctagtttcaattacagaacatgtttgaaaaacatgcagttgtgttaccttcttcagtggtggcatatggttaatctaccaccaccaagtggaaattgggtaggtgactacttcagttatcaaataatactgcctggtaacatcaattttgttcgtatatgagcataaagtactggaaaactttatacttttggatcatttaaatgcatctaaaaatcatagtttgtttcaatattaatttgcttaagaaatcctttttctccctgtcaacattgcagaggccaattttagcacagttgtgacagttccttctaactcataaattacaaattgatggccttaaactgattttgttgttactcagcctcatttctgcatcttaagactggtctcatcctgaaaactagtaagaagagatctaatatcaaacctggatattcttaaagactggattatttaagactcgttcaccaaattttctaataccagtaaatggggacacattatattgaataagggtattgttagccaaattctaagattcatcttaaattgttttcttataagaattgtgtatttaccattttaaaaatcactattattttaaaacacttagaaagtgaacatttgaaaatgatgtgcctttggatgctctgtaatgttaagcagatccagacataaagacaaaagtaaattccagagtatttttgtagccatggaatcaccataaaaaggggtttttgaccccaatgttaccgtaacattgtcttcagcatttcatatttaattacagtagattactcaccaatataataaatatagatttatgagatactttaatgttctaaaacaaatgaaaaccacccaagaggagcctcaccaaacctgaggttgtccagattgcattgactaagattaagtaaaagatcattcatctccagaggtcatgcaattaatctcagagtgggagttaaagcaatgactaagcagaaaaggaagccaaatacaagctcgtaacaaaaggtgctggggctccaacatcaaggaacttgttatttcctttttatttatttatttttttttaatagacctaaaacactcattccttactactggtttctttgggtcctaaaattccacttggttaggtcagctattttccatgactatttttgatacggtcaaacaaatacaaagaataagcttttaaaaaactacagtgggttttcatgtctaggaaaacaatatgacacttcattttatgtgtcaacagaaagtaatttaggatgaatgtataataatccagggtttgaacaatgaaaaagctcaagatacactttaaggaagacatattctactccagggttttataattatttaaattcaaataaaatcaaagttcatcttcacttaacttaggtacctgatacctgttgcaaaatattgaggaaaatgtttggctgtcattccttgaagctgaatctttatacccttgcttgataatccctcaattccctgtggcagcaaatttttatttctagtaaacacaacttgttttttccttcaccttattgagattcaaaaccttgtgttttaaaccaagaataattttgaacttggtcgttccttattgcaaggacttcctccaactagggtgaattttcacccacgattagcctgcctttggagtttatgatgtgaagtgccacagctgatggcccatgaaagagactgctaagtctattgctcacatcaatattcccgctggatattttgctcattccttgggaatttcaaagaataacaaataaccaacaaatcatcaaaaactgtaacatgttacccaattcttgggaataagccagtgagactaaaatctgcttaagtatcacaaatgtgaattcccagcatttcaagcttgtaaactgtatccaacactcaccaatgtctattccatttcttagctgtacagaaggggcacattcatctggtaactgtcaacaatgaggttccttccttcttgaacccagctggccatacaagcaggcaggagttgcatgtttgaccctgagacagcaaagggtattgccctgttgggaagacaacaggattgcgatgtaatctggaatcaatttgagattagcaccagatgctccatgccagtaataagtgctgatcataagacttaattttgtatgctattagaattaatgataaggtataagcatagtatgtcccaaactataggaatgaataagagcagagtgaaaaactgaaatggtaaaacaagaatagaagttttaaaataggtaaattgaaaatatttgtttactttattttcatagcttgagtaaaagagttggaagacaaaggagaaaaggacttgcaagaagccaatttttttttttatgaatgtgtttgtttttcctcaaaagtcagtcgtaaatgctcttcagggaagggagtcagagagagccaaatagtggtcttaaagttttgtttgtgttattatagttctcttggttttttttttacaaaaagagaatggtgaaataacttttgtcacgttagtattagtctcataatcagtggaacacagtccttttttgagtcattcctgaaatagaaatgagcatgaaatgagcctggtattcattgaatattaataggtacatttagatgcatgtctaggactgtgcagtatatgagagatcctttactagtcatcttgaatttaaatattgaaatggtaactaattatatttcactgtatacacttttaaatagtagattatatattatagttggtaaggggaaacatattgtattatttggctggacaacagctaatagtatcacagacaactccttgagattctctaagttctacacataagcttcttaattaccaaactcataacagaatatgtgtcttgaagcagctttgagtcctattttttatataattataaaaatagaagtcaggttaaaaaatgattaatattggtgcaaaaatggttttaggtatcccttcaaagattctcctaaaatgatttgtaatctggcaaataaaaatattctccatgctataaatatgctcagtaataagtcagaaatagaatatcaatttctgtgaattttcaaagaaaaacatgctgggttaagggccaacatcatataacatttattgctttgtattacattatacacacacaaacacacacatgttttgtgaacttttataaatggaatcaataaaaatatgtgtatataaaatatattgttctagatatgaactatatttttatattatacttcaaaaatatgaaaatattgctgagaaaggaccatctgtgtcttctcacatctaacttttcttgattatttctaggaaagcagactaaacacacagttctgacataatacagcatcccattttgatttctggttagctcagaaggctttaccagccaaagaaagtctctgaaaagggcaaacctttctgacctcaggaggttctgataggaagaactgaagcggtgaacacccagaggagagaaaacatgggaataaattccccaaagttctgtaaccacagtgatgtgggtgcatagaggaagacataatttcattcttaaagaatgtccctgttttcacattctttcatttgtcttaaagttgatcttgcagatgatatagtccagatgaatttctgcttaataagaattcttgttcacaaattgacagaaaaatataccaaccatatatgtaaaaacacagtggagaatacccaagcataccataatacctttctcataattcagctaataatctatcagatcatttttaggaaaaggaaatttttgcttcttacaataattagattgagagtagagaattagattgagagtagaggtataaactcgtaataaaaattagaatgtggtttctttctgatgctccgcttcctttgatttattagtttgcatcttatcaataaattcaccttatccaaatttgctggaacaaagttttcaaaaaggaaattaaggctcttatgtgctaatattctgtgtagacaaattagatgctgctcataaccaaaacgatctcatttagtttactctagaacatttgaatagtgggatgagggtctttaaaactgttttggacatgtgaactgaaatataagaaaaccattacaaagttgggtttgtattagttttttgttgctgtcatcataaattaccaaaaacttagtgtcctaaatgacacaaatttattatcttacaattctgtaggtgagaaggttgacacaagttttaccatgctaaaatcaaggcatcagtaaggctgtgttcctttttggcaactctagggtagaatccacttacttgtcttttccagattttacaggctgctcacaatccttggttcatggcccctttctccagcctcaaagcctcaagtggcaggttgagtccttttcacacagcatctctctgacacactcttctgcctcttcttccactttccacttttaaggactcatgtaattaaatggaccaatctggataattccagataatctctgcatctcatggtcagctgattagctagatgctagaagtgaaaataacaaagatatgcaaatatgtatgagactcctttggaagttcataatttcatgggagaattggttgtaaacaaataaatgcaaaattgacagatgtgtcctctggaaatagaggagataaattattattggctcttaaaggccaagtagaattttccagctaaagagaaggagaggaactttccattgagaagcaacatcaataaaatcacaaaagcaagaaagagcatgatgtgatcaaattatagttaactatgtagtgtgactgagcaaaggcaaattagggaaggaggtgctgttcaataacataaccaagagtcagattcagaagggccttctaaaccatgccaagaactttgggagtacaggcactgggcagatttaaaaacaaacaaaaaaccaacaggaataaaagaccagccctctgcactataagaaggtaacctgacagcaaagtggaaaatatctggaagaaaacaaaaaaaaaaaaaaaaaaaaaaaaaaaaccaccagatctttgcaaaaatcattctagaggttctagagatgacagaggtttgaactgaatgaggataaagaaggaatgacacatttgagagatatgcaagaagtaaggcagatggccttgagtgggttaacaactttcatcaaacatcttaaaggaattaagtgctcctcagattttacccaaaccagattaaggctgttctattattaagggtgagttgattcactcagctgttttatagtttcatagagaccatttattattgttactaattatttttattttagggattataattttagaattcttttcattttcaactacttatatatcatttgtttctcatacctaccccaaataatgagaatagtaggaattattgattctattttataaatgaggcaaacaaagcacagaaagtgctttacttaaggtcatattgctgatgagtaatatagccaagtttaaaatgcacgtttcctgatacctatttcagatatttaaaatttaatgtcccactttttttaagcacacattttaaaagatgaggtcttgagagtttaagtaatatcccccaaagatagactatgactaaatagcttgacagaaaatcaaactcagatctttctaacttcaaagcccaaggtcatagcagctatacattactgcatccctcctcacctgctggagaagatcagggaagaattaatagagaagtagcctttaaaatgtatcttgaatgatgtatgtaggtaaggggtgatcttcaagatacttaaaaactatacagtaaaatatacaaatacagtaccccatatataaatatgttaaatatattatcatacatagataatacagctgcttaccaggtgttgttagcagtagtgcaaatcatttgtgaggttattcagtgatgcctgaaaagagttgctaatttttagaaatcacccggtattgttttcagtttgttagggttgattcacacacccacacccagacccattcatactcagggaaggcttcctcagagacattttgtgcttaactccttaaatcctctgcagtttaaaagttccagcagaccttgcaggatccaaaagtgtgcttgattaagggtgggcaagatgtaatggacaaaaaagggattcaccttcctctccccaaattctgacataagagataaacaagtaagccaaccttacttctgctttccttcagtattttcactccccaatatttgaagtcacttcttgactactactctttctcctaaatattctctggagataagggaatggcttatatacagtcattgatcacgtatccccgtttctacctgtctcagtacatttttgtattgctataacagaatacctaaggctgggtaattcattcaaaaaaagaggtttatttggctaacagttctgcaggctgtacaagaagcatggcaccagtatctgactctggtgagggcctcaggctgcttccactcatgacagaaggaaaaggggaactggcacgtgcagatcatatgactagagaagaaaagagagagtgtgtgagagaatggagagagagagaaggtgccaggctctttttaacaagcagctctctgggaaactctcctaggaactaatatagagtgagaactcactcattaccatgagaatggcaccaagtcattcatgagggacccactccaatgactcccaaacacctcccatttggccccaccccaaacatttgcgctcaaatttcaacatgacatttgcagggtcaaatatctaaactatagcattaccttaactaggtcttaaggtatatatgaagtttactttgctcagaaaataaaaaccaaacatatgggctatttcaagctctttacccctttaaaacttttttctatctatttcatctggccttcttttttccagggtcactttatttcgttcttaaatacttcaattaaatgagaaatatttattttagagattaagacagtgttcttagagattgagtaagacagtgttcattctttcaggaattgtcacatttcctttaattttcagctcatttgcttaagcctttcctgagactttctcttcccattaattgcattgcacataacatctgctgtccttgctacaccctcttaaatggaaagtttcatcatactacccagtggtccattttggtggcattccactgaaagaaaaattcaatggattacaacaaaagccacagttattcgaaactcaaggggaagtcaggcttctgagactgtgtagtgccacttcaaaagaggatacaaaagccccaagatcaggcaagatgggctagaatcatatttcatgactttaaaggaagactacattctcaactccaccaaataaagcatcatttatgcttgctatagaagataattaaggaagacaaggttattttgtcatctttcaacttttgacaaccatcccaagtgctttcctctcttcctctatttctcttgttatttgttcctcttcctgaccacctctttttctccaaacaatcgcaaaaactttttggtagaccactgttttccagctttgggctgagagatggactctgatccacactcccaacctcagggaaactctgaagtcttcaaatcactaaaactgtcctagaactcaaatgccttctggaaacaagagaatggaattctttctaacttctctgttccaacctggacttcctaatgccatttcttgaaacagctttagggatactctagttattcatcattgacttggtcccaaaggaccaagcatgacaagtcaaaatgatattcctgaaaacatgatatagctctctggagttcactgtaatctcttgaagctgatattggaacagaagtagctaactggctgagtactctataataagtgggacttattaagacaggttgtttgggacactgggtaatcacagcatgcccgcatatgagagagtaacaccaaagcatctctgtctatgcctgtccttctccaactctaactcgaattaagtcacagccatgaaatcaagaaaagggaacaatatttatctttttcatttaattcattcaacgaatatttatagactcactacagttctcaggctcttgccaaagagaaaggagctaccacagcctttagagcaatagtagcagtgcttactaatataccaggaatatcggccttacatgtctccccttgtgcacaaaattatgcaagtaaatcagggaatcactgctagaatctcccaatactatccaccccacctgtattagtgcattctcacactattaataaagacataaccgagactgggtaatttataaaggaaacaggtttaattgactcacagttcagcatggcctcaagaaacttacaatcatgatggaaagggaagcaaatgcatccttcatatggcggaaggaagagaagtgccaagaaaaagggggaaaagccccttataaaaccatcaaatctcatgagaactcactcactattacgagaacagcatgagggtaaccacccctggaattcaattacctcccactgggtccatcccaccacacatggggattataggaactataattcaaggtaagatttgggtagggaagcaggcaaaccatataaccaccctactccaaaataatcagtcctgtgaattgcatttccttttcaatactttgataggtaaataaaaattaaggttgaatttctataaagagtaagttctttatatttgtagttgttactacattaattgttcttcctaatattatgaaaactggaaacaaaattcaatatcaccttgacaaattgcaaaaaggcctagaaatatgaattaaaattagtagatgatatactgggttgcacatagggacccaatcaaacaatagaaggaaacacactagttagtagcaaaggaagaggagtgaaatctactaatgataacgttaatgttgggagggaaagtctatgcataggaggttgactatccaaagaatgaaagtaattatttgatttcttctgcattaatcagatgcttattagaaagccatattctattttcctcaggacattctgaaagtttgtgaagagaaaaagtagatagggtacaagtcttaatatgctacatggaaaatatggttgataagaaaaagttaaaagtcatataagttacagaaatcactaaatttaaagattcaaatttctaaagagctcttgtgaaaggatgacactctcttcagaatcattaaaaattacactggaaaaccggctgtcttggaattgatacttaaaattcaccccaaaaatagaacttttccatcagtggtggaaagggacctataaataaatatgtgcatatacatttatatataaaaaatatatacacacacaaacatacatacacatttgttccccaggtctatacttccaaacctaccctcatcaataatgatagagaaagcacagtgaaaagctgtaaaataggtacagtaaaatcttactaatcttgctaaattacagggtggatatttctagattagttaacacttaacctccaaacaaattttaaagatgattaaatcagttgtattcccctccaagtcctatatgtaaccattattgatgaagtaattacaaggacctatcttgatgattgtggaaatggatgttgaaagtatttctgattaagaacagacaattgcttcaacaaatagaatgggagaaaaagtacctagaacaatctgcattacctgctataggtgaaatactccccttatcatatattatgggtaaagtttatcacaaattttaatgtagtagaggttgagtggggttttctatgtttttcaaactagttaagaaaccagtagtttgaagcaaaatctgcaacaaaagaagaatgagtaagatcctgaagcatagtgaaaccatttaagaacgtatttgaagatgcatgaaaatcatctttacatatgtagctaataaagagctgaaaacattaaaccatcactataaacatttatattatctgtagctaaaattgcatggagtgagacacatgatacgtggagcagcacaaataagaaactgggtagtcatttttccccacatgatgcaattccagattaaaggtacatttttcccccatagaccaataaaaagcttcagagaaagacatagtgggctgtgttagaatgagaattagacagcacagtcaactagtgcataacatgatgaaagagtagaatactatcaagatttcttgtataatcaatcacagcaaacatgtcagcaagtatgaggccatccgctcctgtccatacaacccagtagacaatttgggtaagggaatgagtatagcagtgccaaatgtggctatcaacacttcttctgtttctgtctcaaaagaacaaaattctaagacaagctcttagaacaaatggaaatttatccaaataaaaatcaaatgataaatgcccagagaatattctttctttggaattcgttcaattctttaatttaaccagctggaataaattttcaagtagcattctgctcagccttttgaaatgaaggacttttctgttaattggaaagttatattccatcaaagatgaagacagtgatcttgccttagtgattcttagaaaaaataaaaggcatttggtgaatatttatcatatactgattccagaacatgtattttaagcacaaatgaatgagctgtgggcctacacatttaactaaagaaaaatagggaaaattcaaatacaagttttattttaaactctacataaaagctaactttcactatgctcagtcatgagaggaatatgtaaagagaaaatagaaatagaaaccattaattttgagaatgaaagatggataatacagctgtggttcctgattttctgaagcaaatgaattagataagtcaacacatttaagtgttctttactgtgttactggaatatgtgttattggggctggggaaacatgagagtcaactcaaaaagatctacagcaagaaaataaaaatttactgggaaaaaattattttgaaaattcatatttttaaagcaatctgtaccataggcagtactttaaacttagtcattgattatagatatattaaataacattgttacatttaaattttaaattggcacgttaggcaaactaatttatcgcaaataatgtgaaaagttgtttaaaaattaatgatagtcaagtactaaagaaataatttttccagatgtcttaaaggaatcactggatagatggtctgaattataattgtgtattctgatttaaaataattttataggaagacttctaggtaatactatttatgtactttcagtctggcaatgtgtgtataacagaaatttttcaaagaggctgttccacttttttaaatatttaaattgctgagagaactttttaaagggtaatatgaaataaatatttaataagttccatagactcacgcatattctccagcttgagatggaagatggtggttgaagcagcagggggcgccagcgggcatggtggtgagatggggacagggtagagtacgagtgttacaaaaaaaagatgaacacatcaattcgtttttgagatagtcactaatattttgagaggactaggtccaaattgaaaatttgggatagaacacgacaatgttgttaggcaggctttaatggtctttgaaatattagtgttaggacgccccactgactaaatttctgaagataggtaataaaattcccatattataagctcataaacattatataaaacaaccaaagtatcctattcagggtcatttttttaagggaacaataatattcatccaacaagctagtcatgaatttcacggcaaaagtaatgaataatatttgacggtgcttaatagatgaaatttgccaacataccctttgataacaagtaagaatgagaataaatttatatgcttatttaatagatacaattatttaaaacccaagatctaattcaaaatgtgttatgcaaacatgcttagatcaagaaattgtctacatgtaagtcaatgtatctgatttactttccaagagttttatgatctatcctaaggtgatagataggatttcaaagtcaagataacaacttctgctctgaagaaaaaattacttattgtaaatgaacttttaaccaaaaagcagttgatacaagagaaataaacccatacaaaagaatgcaaaatctaaaatatttaatataaattataataccctgctagcttttaaaatattatacaataaaatacagaatatcctttacttttataatgagtaaaattcgtaaacattgccaatatttttaaaaatctttgggtactttctcccctgatcacttttaactgttcttttaacatagaacaggaaggcatcctagtatgcaatacccagtgcctttaatagtttcttttggactccagctaatggcccttttaaatggaagcaaggattccaggctggggttccaggcagcagaagcaatgaggtggaatggagttagcttgaatgaaagggttatggaaacctctgtcacgacattgagccaacattcaaaatttcagattctgagtctttagtggataataaaattatttaaacaacagagaaaaaaatttgtaaaggcctattggcaatggtccatttgtaaggaaggtatttaattaggcaaaagagagtttattatgcttaaagcagactatgaaaatacacattctaaaaagttgtgattactgatatttatgatgtctgctataaggtgaaatgatttataataggactgcattcaaacctcaagtagcattttaaaattttaaagctatataatttttctttctcttttttagtattaagtataacaaaatatgaaaatatgtgataatttcattaaagcttcaaaaatgtaacagtagtagtctaatggaaaattatttctaaattagatataaatgatgtataattttcaagttacatatatatatatatatatcatacctctatatgttgggggagtggaaatactaaaatataggcttgtagcaaaaataaaaagaaagagaatagagaatgagatagtgctgaatggtgctgactcaaaaagtttattccaaatgctattaagttctgagttaatttctgataagcagcttttccttgcccagcaaattcaaatttcaagagattaagaaagtacactccaaatcttgatttttataaaactcctctcttttaaacagttagtccacagctgggctctttccttgcctcagtagctgaagtgacataaacaaggatggcatgtcacattgtgctctattgagaaataatgtggaggcagaagggtgctgtggttaggaaccctccttatcctcatctgtagaacaggggttgaatagagcttctaggcaccgtactcttacttagaagttggcctggtacatattaaaagtaatggcacaaaccacaattattttgcaccaacctaataaaagtgtgtgttgaattgtagttataattattcttactatttttaaaaacaaactatccaggtcatcttcaccttgatctgcagcagggtcctaattgggagctgagaacacagagaggagaaatgtaaatagtccagcctaggaagaggttaggagagtgaggaaggtttccctgaaggccagataattcaacagtaagtctgagttagggcaagggatctagaaactgcattctagataaatgtatccaatatatgggatcagtaaacattatggtgggacaagtgcaggggtgactaaaaagacaagtgtgaggccagcaaagtagataagtaagcaggggtcatatcacagtggacaaggaccctgagggccatgttaagaagcttgggtttatctgctttcatttcctaaagtttatactcagtgccttccaatcattatgttcttgtttctaaattcccaaaacagcatgatacaaatagagtgcctctcttaaactggtcctttgaaattgatgataaaatgttatttcaatctcagtatattttaatggtcagagctatctttgtaaaagtgggctcaaagtaatatcccaaattaatagcatttagtagagtatgtaatgatgtatcaaattatttttctttgaataattaatcagaagcatcttgaaaattaaatagaaaaggcaatagaattcgtgtgtaacctaccgcataggtaaatcaggtagctttaaatttcagtgtggagaaattgtgtgcttatttatcaaaaagcaaaagacattcattctttgatatttttactatatttgttgtaaattcctaggttaaatttagagcaagaagaagttttctattttattaaaacaaacaaaagacatttctcaatttacttgataataatataggcctgtaaatatgtatctacacaatacattataattgcccccacaaaagaaaaaagtcatactatagcaattcctcttccttgcaaattttcccagtgatattttaatttaaaataacaggccgggcacagtggctcacacctgtaatcccagcactttgggaggccaaggcaagcaaatcacctgatatcaggagttcaagaccagcctgaccgacatggtaaaaccaaaccccatctctactaaaaatacaaaattagccaggcacggtggcacgcacctgtacttccagctactcgggaggctgaggcaggagaatcacttgaacctgggaggcagaggttgcagtgagccaggactgcgccattgcagtacagcatgggcaaaaagagcaaaactccgtctcaaaaacaaaaaacaaaaaagaaaaaagaacaaaagctggaattttcattctctatacataataatcaggtccaattccagattcaaaaataataagatcaacccctttttcacactgtgagtgctttatagaaggcataaagccatgggcttccagttgaatttcattccacaccaaataaaaagaaaagaaaaatgtaatacttatttaattggtttgagtcatataattcgtgatatttagtcctcagtctgtaatgtggaatacatttttagcatttgggtaaaaattataacctagtttgtcttgggaagtgaactacttacagctcaatggctccccttagtgacacttcgcaagaaattcacaaagcagcagcttttatgaagacctatagacagattttatccaaacatcaagaaaatagctgctattcataatttaagtggttctcaataagtgaattacagttgtgattctagggaaagcaactctttttttcataacctcattatgtttaaaggatattgaacgtgttctatggtttgcattttcacttggaatttaaatatatacaagttaggaagaataattcaggatcactctctttgtcattttttacatgtttattttttctagttcatatatgcacttgaacaggttttaaaaagataacctgcaattaatttaatttatatctgggtgcctattccaaatttatctattaagaaaacttgccttaaaattagtagctacagtaagtcaaaaacgtatttgatattcattaggaaaaatgaaagaaacaaaggagcaaccatgcaatttgaagtaagttttgagagtatatatttgaagaaattgggtcttctgttgctctgcagctttggcttttaaatgtggttgcacatcaaaataaactgggggggaggggtgtgaacttgttgttgactacaggttcttgggcccctcataagaaccactgaatcataatctccaagggtgggatctaggaatctgtatttttatatgttttggaacattgtctgcagaaggccataggaaatgtttatgtaaaagactgtatgtgtttatactaacagaaaataatttcagaatcttaaaaataacaattatcaattcaattatgtgatactactatgcaacaaaatcttaaatatggctttttggtctacatggagattttagctactctttcaaaaattaaggctcaaaaataccaaccactgactacattccctctacagcatcttattacttacagcaattttctgaaataggaaataaggtcaacatgtaagaatagcctattggccttttctaaactcatcacagaaacatccaaactctggcctgctatctgaattcaatacttgcccttctctagttttcagtacactggtcctcaggacaaactcccaacatggcaattgaagcccgtatatctttccagcttctatgggtaatattctatatatagactctgatcaaaccaaggaagttgactttcaatgccccagattcaccatgtccttgcatgccttagtgcatgttcactgcctggcatgcacttcttccctcatcagcctagcaaactctcagtcattcttttaggctcacctcaaacatcattacatcaggggaattattttcagtctctgaaatcattttcagtctctcttcatggagttcaatgctttcccactgtacccccaacaggaccttgtacacacctctattttagcattaacatgtgactataattattggcagtctccatatctaacttatatccccaggttttatcacacatttttggcacagagtaggggctttgttcatgtttgtgcaaggggttaataatattagttttcatttgtcccatgagtaacatatgccagtcaccatgctaaatgctctaccagcatctcatttaatccttatgaagtttagcaagaagtaaggattattcacattttaaatatatcagagagttaatcctgagaaatatcaacaacttgccagagttcacacaactagttggtggcagacctagaatttgaaaacagcatttttctggccctaaggacagtgtacttaaatgttacaccatagtgcttctctgcaagggctcagattgtacttgactgctaatagcaaattctctttgatgttttctacccaaacaccctcataggtagaacatcaaggggagatgaacgctgttttaatcactagaatgttccaaaacccagttcaggcaggtacgtgcgtgtacacatgcacacaaacatgaatattcagtgaatggcaaagcacacgtgtgtgtgtatatatatatgtgtgtgtatatatgtcagattgtcataactggaatgcttagtttgcaaaattgccaaaaaagcctgaaaaaaatattaaccacatcaatgaaaagtcaccagaataaaaaaggaagtcccctttaatgaaaaccttacaaaattatcccaaattacacgtgatttttaatggactacagccactcttgtgtatttctattttatttcttacacaagcagaaaatatatttatgcaaagggtagttagcatttccaaccactaacacatggcctgtaaaaaaataacaacctcattcttctgttgtgcaatagccctctgttgagcagcaataatgtacaatgtgttagtttcctgttactttactagagccttccctttcactcactgcccagactagttattccttggacataaagttataataccgagtttcaatctacttccaaaaatgtttaggcctgtcttaagaaataatcatatcagtttgctaataagcagaaatgcactgccagttgaggatgttgtcacaagtggctaaaaaacatataaatcaatctgtgaccaaggaagaaacaatacatttcttatgtgtccaaaacattatggttgggatcacagctgtaagatgttggaccgtcatcaagagaacaatgtcaaacactgaacttctggatgatttccataaaaataacattttgcttggggtcagtagtttttatggaactttggaatggtttttgctgacaattttttcgagttgaactcaaacacctccaaaatgctcctcaatatggaaatattatgtaatccaacctttgcagccatctccttgtgaaaactaagcacatagcatgaaaactagtatttttctctgtttgtacagttttataaaatttaaattatgctacatattcagaaagggaaacttactcttcagttttccctgtttggttattatattcaagtcagcacatcaaatgtgtactcattaaatccagcatggaaagaaggccctgatcccttctgtagaaatcttatcaacccagcaaaattcttttaagtgaaaagaataatggaatcgagtaatcagaatataagtagttcagtttaggcataatagttgcctctaatgttgtttgttcctctctgtatgtccaaaacaatttgcttcacccttgaatgaattctgatttttgtcaattgtccctttagattccagaatttgaaggtatgttgtgctgagcccaacaaggaaagctttcaaaaagtaactggaaggttttataaatacagtctcatgacaaagctagatgtggcataaaatcattaatccaaggagaccgtattggcgtagtatacctatgcaatattaataataccactccctaggattctgtaaccagagcccaagaaaaggaaagccaaaccactgaattcaatatttgcagcctacttcaggacatgaaaatattttggttctctcatgcagacaatttctccaaaatatttttgtcaaaagttacttattttagacagtctaatttcaaattttaaatgacccagtatgtgggatacacattcagaatttgtcatacctcaggaaacagttggttcctagtttttgtttactgtaatattgatttgaatctaggtaatttctcattgggatatatgtgttcatggatgttactaaaaccatgccttcagactacactgtagactacatatataaaaggtgtacatgataataaaacatctagttaattcactgtttagaaataaataaaaataatcatccaatttggtgccaggtttatctacttcgatcaaattattctcttcttctaaaactcccagcatttctccaatgccgacagaataaaattcagttcttcaagtggctccctgttggctacaataataccttttcacatccaaacctttaaagtcatgttgattccacttttaaaaatgtctcctctcataatgtgagtctgagttaaatctatgcttcaaacccagctccaggtcgggggcctgcatgaaatccagtatacatgtgataaatatctactcatttgctggatagagactcaacctgccctggtagcttgtaccagagggttattgatcagttatagtcatcaccaccctgcatgtagagaaattataatcaaaattaatttcaacatacaaatatttatgttaaaatacaattatcttgttattcatccttattatttctgcatttgttatgcaaatcagttcttttctcttagatagcaggcaaatatcttgacaaattataactatgtaactgctacttcgaaaaaaattgaatacaacatggtaccttaaaaatatgagccagataaaaatctctcctttttttttggagatagaatctccctctcttgctcaggctggagagtacagtggcgctatcagggctcactgcagccttgacttcccaggctcaagtgatcctcctacctcagccttctgcatagctgggacacaggcatgcatcaccatgcctcattgattttttttattttttatagcgataaggtctcactatgttgcccaagctgatcttgaactcttgggctcaagcagtcctcccacctcagtctcccacagagctgggattacaggcgtaagccaccaggcccagccaaaatatacattttaataaatgttttcaacagcaagaaatctatctaaaactttccatgaaacatgcataaataactatcatgtaaaataagttccaaacttagaagaacagaactatttggatttcaaacagtcatatgttagttgccttattatatcatatacgtgtttcacatttacattgtttggaatataccacagacttaataatagttgaatgattgaaatagtagatatttagtatctatcattatgatatataatctaagagaaatttaagtcattttttaaaatgtaattaaaaaatagaacataattgaatgtaatttttaaaagagtatcctttcatttcaggaaaaaaaggaagggagaggaaaagaaaaaaacctaataaaggagaaagtaaagaagcaatacctgacagcaaaagtctggaatccagcaaagaaatcccagagcaacgagaaaacaaacagcagcagaagaagcgaaaagtccaagataaacagaaatcggtatcagtcagcactgtacactagagggttccatgagattattgtagactcatgatgctgctatctcaaccagatgcccaggacaggtgctctagccattaggaccacaaatggacatgtcagttattgctctgtctaaacaacattcccagtagttgctatattcttcatacaagcatagttaacaacaaagagccaaaagatcaaagaagggatactttcagatggttgtcttgtgtgcttctctgcatttttaaaagacaagacattcttgtacatattatcaataggctataagatgtaacaacgaaatgatgacatctggagaagaaacatcttttccttataaaaatgtgttttcaagctgttgttttaagaagcaaaagatagttctgcaaattcaaagatacagtatcccttcaaaacaaataggagttcagggaagagaaacatccttcaaaggacagtgttgttttgaccgggagatctagagagtgctcagaattagggcctggcatttggaatcacaggatttatcatcacagaaacaactgttttaagattagttccatcactctcatcctgtatttttataagaaacacaagagtgcataccagaattgaatataccatatgggattggagaaagacaaatgtggaagaaatcatagagctggagactacttttgtgctttacaaaactgtgaaggattgtggtcacctggaacaggtctccaatctatgttagcactatgtggctcagcctctgttaccccttggattatatatcaacctgtaaacatgtgcctgtaacttacttccaaaaacaaaatcatacttattagaagaaaattctgattttatagaaaaaaaatagagcaaggagaatataacatgtttgcaaagtcatgtgttttctttctcaatgagggaaaaacaattttattacctgcttaatggtccacctggaactaaaagggatactattttctaacaaggtatatctagtaggggagaaagccaccacaataaatatatttgttaatagtttttcaagttttgttcactctgttttattgtttgttttattgagaaattcttactcttagagactcatgaattaagaaagagaattctgctaactcagagaacctggttcctatgtaattcagaatatattacatttctcagtaatatttgttttttgaatccacctttatctgagccaatggagatttacttatagcgtattaggagatatttattccattttcttattttaatcaacattctaattatagacacatgggcct

SEQ ID NO: 4 - DNA, 192 bp, Artificial sequence
  Exon 2 of the human RSPO3 gene (ENSE00003551533)
tgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaa

SEQ ID NO: 5 - DNA, 274 bp, Artificial sequence
  Exon 12 of the human PTPRK gene (ENSE00003641852)
tgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaag

SEQ ID NO: 6 - DNA, 23 bp, Artificial Sequence
  Forward primer for PTPRK(e13)-RSPO3(e2) fusion
ggagaaggaaactaraacccagt

SEQ ID NO: 7 - DNA, 24 bp, Artificial Sequence
  Reverse primer for PTPRK(e13)-RSPO3(e2) fusion
gtctgggcttacatgacaarcatc

SEQ ID NO: 8 - DNA, 139 bp, Artificial sequence
  Exon 14 of the human PTPRK gene (ENSE00003466930)
cagcagcaacagaagaaccagaagtgatcccagatcccgccaagcagacagacagagtggtgaaaatagcaggaattagtgctggaattttggtgttcatcctccttctcctagttgtcatattaattgtaaaaaagag

SEQ ID NO: 9 - DNA, 23 bp, Artificial Sequence
  Forward primer for PTPRK(e12-e14) WT control
ggagaaggaaactaraacccagt

SEQ ID NO: 10 - DNA, 23 bp, Artificial Sequence
  Reverse primer for PTPRK(e12-e14) WT control
gctattttcaccactctgtcygt

SEQ ID NO: 11 - DNA, 686 bp, Artificial sequence
  Exon 1 of the human RSPO3 gene (ENSE00001858691)
tccctcccccctccctgccctcctcctcctcctcccctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaa

SEQ ID NO: 12 - DNA, 19 bp, Artificial Sequence
  Forward primer for RSPO3 (e1/e2) WT control
ctcyttggcagccttgact

SEQ ID NO: 13 - DNA, 21 bp, Artificial Sequence
  Reverse primer for RSPO3 (e1/e2) WT control
aatacatcggcagccaaaacg

SEQ ID NO: 14 - DNA, 21 bp, Artificial Sequence
  Reverse primer for RSPO3 (e1/e2) WT control
aatacmtyggcagccaaaacg

SEQ ID NO: 15 - DNA, 26 bp, Artificial Sequence
  Another probe for the RSPO2(e1/e2) wild-type control
ccacgaaccaattgtrtcgcttcctg

SEQ ID NO: 16 - DNA, 22 bp, Artificial Sequence
  Forward primer for internal control
gcgcccgaacagtatcgcgttt

SEQ ID NO: 17 - DNA, 20 bp, Artificial Sequence
  Reverse primer for internal control
agcctccgctagtcacccaa

SEQ ID NO: 18 - DNA, 416 bp, Artificial sequence
  Exon 1 of the human PTPRK gene (ENSE00002192844)
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcag

SEQ ID NO: 19 - DNA, 18 bp, Artificial Sequence
  Forward primer for PTPRK(e1)-RSPO3(e2) fusion
ctsyttttgtggcgytct

SEQ ID NO: 20 - DNA, 19 bp, Artificial Sequence
  Reverse primer for PTPRK(e1)-RSPO3(e2) fusion
ctcyttggcagccttgact

SEQ ID NO: 21 - DNA, 123 bp, Artificial sequence
  Exon 2 of the human PTPRK gene (ENSE00003533687)
gtggctgtacttttgatgatggtccaggggcctgtgattaccaccaggatctgtatgatgactttgaatgggtgcatgttagtgctcaagagcctcattatctaccacccgagatgccccaag

SEQ ID NO: 22 - DNA, 18 bp, Artificial Sequence
  Forward primer for PTPRK(e1/e2) WT control
ctsyttttgtggcgytct

SEQ ID NO: 23 - DNA, 19 bp, Artificial Sequence
  Reverse primer for PTPRK(e1/e2) WT control
cctggtggtaatcacaggs

SEQ ID NO: 24 - DNA, 19 bp, Artificial Sequence
  Reverse primer for PTPRK(e1/e2) WT control
cctggtggtaatcacaggc

SEQ ID NO: 25 - DNA, 294 bp, Artificial sequence
  Exon 7 of the human PTPRK gene (ENSE00003783990)
aaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcag

SEQ ID NO: 26 - DNA, 24 bp, Artificial Sequence
  Forward primer for PTPRK(e7)-RSPO3(e2) fusion
atccgagttctrcttacaagacct

SEQ ID NO: 27 - DNA, 19 bp, Artificial Sequence
  Reverse primer for PTPRK(e7)-RSPO3(e2) fusion
ctcyttggcagccttgact

SEQ ID NO: 28 - DNA, 303 bp, Artificial sequence
  Exon 8 of the human PTPRK gene (ENSE00003657054)
aacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatg

SEQ ID NO: 29 - DNA, 24 bp, Artificial Sequence
  Forward primer for PTPRK(e7/e8) WT control
atccgagttctrcttacaagacct

SEQ ID NO: 30 - DNA, 21 bp, Artificial Sequence
  Reverse primer for PTPRK(e7/e8) WT control
ccgtcttgcctgtatttsagc

SEQ ID NO: 31 - DNA, 47023 bp, Artificial sequence
  Human EIF3E gene (ENST00000220849.9)
tgttcgtttgtcggcgctaccaataaagttttagtgagcacagactcccttttctttggcaagatggcggagtacgacttgactactcgcatcgcgcactttttggatcggcatctagtctttccgcttcttgaatttctctctgtaaaggaggtgagggggtctttgggcgcaaggaaggcgtgggggcggatgaggtgctgagcaaggccgaaaggtggtgtctgtagtcctaggcctgacacgtgcgaggcggtcgcgagtttggttcctggacggacactaaggatcttctggtagtttagcgtcgtctcagttaagaagcaccgcactattcggcagtgaggaggagggaggttacggagagagaaaagaagtctctttcacttactgaggtgtcagtgcgggagggattttcgcatcatttcttctcggaagttggcgattcgctggtttcgctagagaacgttagagcttcacaggctggcttgtaaaagcaacctggagtgctgttagagcttttgatttttcttttgggaactgtgggaagcctgggcttggctgtgggtttttgcatgtcgagtcttttggagtgattctcttacacttaaaataagtatctagcgctttaatttccatgaagttgtgagttctttgcgttttcttgtcttggttaagtaggactttctagaacagcatatttcgtcagatggggacggcgctcccccgcccccccccccagaaaaaatccctccaatctttaaatgtgttttccagtggatatattgtactgacttcatgtggtttgaattggtcgttaatattcaattatctactcaagatatcatgaataaatgtgtaattctggaacttcattttaaagcatatgtcagtcctaaaagttttattggacttgaaagttttggctaaaagaaaattgacattagttataccgtgagtttattgggaaattgatgcattttaataatgcaaagtaatttgcagtgatgaaggaattcgaattttttcagaaaaataagtgagttctgtttctggaagcagactacaatataagtctacttagggaactctagatttggggagtggattttgtgtagcaaaagacaaaaagcaataaaacaaaaacgtcccaaaaaccagcgtccaggtgttgtggctcgttagacaggtataatcctcatattcatatgcaccttttctaaacatagacaactctaaagttgttgacgttaggtaacggctaagatcattttcagtaaatgtccaagaatgtcttgtcatgtaaaactttctcttgatatatttttgctttgattcttctttttacacctgtattttagaccttgagtaaaacattcgcatctgcattgttttcttttctggaaaagtgaggacaaaagatctagtaaaaatgctatattttgaaagcctttaccagctgcttgtagaagtacttctgaactagctgaactttatatatttttgtgttctttataatttcattttttttatggcacacagaaggaaaggaggaatatgtaaatgtgaattagattttcatagggctagacgaaaactatgaactgcaggcagttgagaatcagtgggaaaaactgcccaatacccacctctttggagaaaatgttggtaagatagctgtaatacaccaagaggaagacagatgctggagtatttaattagcaatttctaagtacatttgactcttggacagtacaggggttaggaacgctgagctctcgcagtcaaaaatccgttataagttttgactcccccaaaacttaatatatcctaatgctgacaggaaggcttactgagaacatggacagtcctgtgttgtatgtgttctatactgtattattacaataaagtaagctagagaaaataaaatggtcttaaattataaggaagagaaaatacatttactttttagtaagtggaagtacatcatcatgaaggtcttcattgtcttcatattgagtaggctgaggaggaggagtaaaaggaggggttggtcttgctgtttcaggggtagcagaggtggaagaagtagaggaagtggatgggaagtcaggaaaggcaggcacacttggtgtaacttttattgaaaaaaagttgtgtatacgtggacctgtgtggttcaaacccttgtcgtccaagggttaattgtatagggccatataactgagaaatccaagataaaacccagacatctcaccactaaacaacttacctatcctttagagttgaatgtttttgatataaggtaaaaataaatgtcgaagaggtaggtactggtagagtgctatcaaaattgagattttgttatcttcagtgagcaaagaggactttgaggaggtgaggctttgagtcttgaaggcaaaatggttagaatagagtcagtgatcctgctatgtgaggatacagcagccccccccccccacacccccttagcagtttcaatttctgcagttccagttactcatggtccaaaaatattaaatggaaaattccagaaattagcaattcgtaagttttaaattgttcgcccttctgggtagtaggatgaaatctgtctcgctctcttgcttaaaactgggacatgaatcatccttttgtccaatgtatccacactgtatatgctaacttaattgttctattttgttattgttcatctcttgttcccagtttataaattaaactttatcataggtatgcatgtataggaaaaaaacagtaaatataggattggggctatctgcagtttcaggcagcagccgctggggggtcttggaacatttagctcatggataaggggagactattacattgcaccaagagaaaaacagtttcatatatttgtagtacattggagaatataagcttcatgagagcagaagcttccttgtgctctcagcacataatatgagtctggcataaaggctttttatgattgtttaataaatgattgaatgaatacatacttgtttctcactcttctttattttcatgtgaagcagaaggccagatagtgaaatatttaggaccctgggctctgaattggacctttcatgactcggtcatttaatacctctgtgcagtcagagcagattcttttaccctcttaaccttttctcatgaataaaatgttaatactaccaccaatctcatcgggttagaaaaattacatgagataatgcatataaaacactacgctcttctgggacagagtgagtactccttaatgttttgtgttttgagacagggtctcgctttgtcacctaagctggagtgcagtggcacaatcttagctcattacagccctgactttctgggctcaagcaattctcccacctcagccccagaagtagctgggactacaggtgtgcgccaccatgtccggctgattttttttgtattttttgtagagatggggtttcaccatgttacccaggctggtctcaaactcctgaactcaagtgatctgccaccttggcctcgcaaagtgctgggattacagacatgagccaccacccttggctctaaatgttttttattttggaagactagcccattctgtattggtatgggatgggaggggggggcagtgagggttttgaggagtaaggtaaggactggaaatggttactaagaaactgatcaaaggaaagtacaaggattggttaagtgtggagggcccaactgagattggaaatcataccttagagctaataatggggtcattctcagggcgaggagcggtagaaggctatgggagtagtatagacatatttaggggtaggcttgtatgtaaatgccatttagagaagcacagatgtgatcgaataacattattccctaattttgaaacattttgtagtcatccttagccagaacctagagaataggtgactttttttccagagttagtgattgacactgaattgtatatagttggagaaattagtttgaaagaatcaatgatagaactgaagagaaaatctttgaaatagctaaaaatgatatccaaactaaggcagaaagtgacatcaaaaagggtattacaaaaattagaaagggcagaaagtctgagatgatgaagattttaatggtaatggtggaaggggttatcagttttaagttggaattcttggagatgaggggttatcagttttaagttggaattcttggagatgagatacatgatgaaaattgtcataatttgaggaataaaggaattttagggctcaagcttttaaagagtcatcagtatggcattatatttgtgttgaatgacagcagaggaagagacagcaaaaaaagattcttaatctgttaaaaagtaatatgttttcaagaggttgatagacgacggatcagcagactatagcctgggaatcagatagcagcctgtttttgtgtggttttggggctaagaatagtttgtaacagaggaacatttgcaaacattagcaattatagaatattaactttataccccaattaagtgaaataatttctcttgaaaaagcattctattcttattaatagacctgtattacaaaaacttttactgttattatttctgtttcaaaatttttaaaaaattgtggaaatttgattctcgtttttcatgtgagtacttatatagtattttcaattgttgcttcttgatacaaagtctgaagtatttgctttctgcttatgaggcagaattgagaggcatatgtagatttgagaacaggacagtaacacctgatggtagaggagcaaggctattgaatctattgtggagagagacgtggcaaattaaaagttactagtggagtggggagaggtagcgtgcttggaaaagaatgtttttatttaagattagtgtttctatagggcaaagtgatgagaagttaaggttttttaggtaaattttttatcagatatgacgttcattcatacaagtacacaaatataaatgtactggtcaatgatacatatttttttcaaaatgaatagcgaatacatttatgtgaccaccactcagattaataaataaaacattacagacatccttttttttttttttttttttttctttttttttgagacagagtcttgctctgtggcccaggctggagtgcagtggcgcaatctcggctcactgcaagttccacctcctgggttcacgtcattctcctgcctcagcctcccgagtagctgggactacaggcgcccaccaccacgcccggctaattttttgtatttttagtagagacagggtttcaccgtgttagccaggatggtctcgatctcctgacctcgtgatccgcctgcctcggcctcccaaagtgctgggattacaggcgtgagccactgcgcctggcgacatccttaaaccttcatcttgacccctgttagtcactactcacaccccctaaaggtaagctgtagtctgatgattcattttgcctgtttttgatttttatataggtggagttaagcatttaccaccatgtactgctttgtatgacatctttcactcagcattgtttgtgagtcatcatgtttttaggatagcagtagtagttcattgatttttcagtgccgaatgttaatctattatgagtatgctgtggtttgttttctcattttaacattgatagacttggctattacaaatagtgctcctgtgtacatttttggaagtgcactttgactatatgcacccatttgttttggatgcctcgaaacaattgctggatcaaaaagtatgtttggctttgggagataaaaatcttacaaagtagttgtattcctgccagaagagaataggttccagttagtctacatccacaccaacactggtattgtcaggattttttaggtttttattgtaatttttagtatgcatttccttatgattaatgacgttgagaaccttttcatgtgtctgttggccatttggttgtcttcttttgcgaagtgcctatcttttagccatttcaattgcaaggtctgtcttgtcttactcatttataggagttctgcatgtaatttggaaggttcgattttgctctcatggctaaataccctttgaccaccttcatctttattttttgtgggcagtgaaatattgtggcattttcttggatttttctttccttgcaaaattaagttcagtacagaaatcttttcttttgctgaagcatttctgtccgtgaatattttgtagaatctttacatattactcagtacacttcatgttgttgtgagtttgtgtatatgtatctatttgctccctgtactataggttaaattatgcttttttggatcctttgcaaagcaaaagcctgatctgacatggttgacttaaaaacttggtgcaggttgtttcagcaatgtggatggagaagcatataggagtttattactgattacctggatgtggagaagtgacagctatatgtgctttacaggaaagatggcgtgggttttatttatacacagccttgcctagaaagggtaagagatggtttgtagggacacataaaaaataaggtcatgtaaatcagaagtaggtgggaatgtctacagtaattctcttcattttaaaatttttaggtaagtaaaatacttttacgtctataggttggttgcttgccatattgcttgccattattacaagaggggaatgttaatggtttatcgtattttataaagtatttcttgaaatatatttccaggtaaattagttttagtattaatcagtttatttggggaacttaaatatattcattagaaagttatcttcttttgcagatatataatgaaaaggaattattacaaggtaaattggaccttcttagtgataccaacatggtagactttgctatggatgtatacaaaaacctttattctgatgatattcctcatggtaagttttgtcattagaactgaaacttgtcttgtgacttgaggatgtgtgtattaaagttttatgatttataagacagctttagccaaaaggcttaaatatgatttgaatgttaatgttctttgggtgagaggttatataaaggtttcatatcttccgaaatatattgttttctccctgtgaaagatgtggaactactttaaaatatggtcatcagatgccttcatttcatagtatgtatcatcaaagttgtgcttatgattcacattccttagaattatctgagaatgttgcagttcttgggttgctaactttttcagttagtgcattgtgtgccttagagttttgtgtttttttttttaattttgaggcatctagtgtagacattgttctccaaatatggtccccaggaccagcatcatcagttcacctgggagagcttgttagaaatgcaggtttttggccacacaccagacctacttaatcaaaactgttaagtggtcctcttaagtttgggaaataattctgtgtcatttcttcaatgcacattacatttttaaaggttccaagaattttggcagtagagaaatacagtatactgtgattaaattggcatttctcaaaatttgatcatagatcttctgtgtttcagaaagactgctctagaatatactttctaatatataatacagacattattacattaaacataatccacatgtttgacttgtagttccctgcaataacagtatctcttttttagtttgtcatggataaacaaaaaggaaactatttcttagtttctttctttttttttttgagatggagtctcgctgtgttgcccgggctggagtgcagtggtgcgatctcggctcactgtaagctccgcctcccgggttcacgccattctcctgcctcagcctcccgagtagctgggactacaggtgcccaccaccatgcccagctaatttttgtatttttagtagagacggggtttcaccatattggccaggctggtcttgaactcctgacctcgtgatcagcccgccttggcctcccaagttgctggggttacaggcgtgcgcccttgcccctggcctatttcttagtttcttaatgaaacattaaggtgttaccagagttggttatgtgcaagttttctccaccttttcatagtatagtaaaaggaacgatagaatttggtttgagagattatagagctggatttgtggttaaaagagattatttaatggatttaaattccattcaacctagttgataacctgtaatagtaatatgtaaatccctctgagtttttcttcaaaaactctgggataatattcacctaagaaaattaaatgagaacaaatataaaaacacttggaaagaagtttctgcaatggagaattaaatgatagataattgggtcctaccctttttttctttcacatccctctgtcaccccaaggctgtatattctctagtttccctcaagagtaggaagaggattcccttttcctttttgtgcctttgtattagtagaaaaaagaaattagggatcggggacatttctgactgagtagcccatggcatatgaatatattgggggtaaataaatatatgtatagtttaaatacactgaaaaatttccagacattctcatgatgagtagcacaatttaacattccttaacattgtagtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccaggtaaactcgtcttaattttgaattctaaaaattctcctttctggattaatacaaatgttaattcaaactttatccagtatcccatagtaaaagttcatggtttaaatgagtgctttattcatttttaatttttgtttatccttattttgtaggggccagtataattaataaatgttaatattaacactaagtttttttcctaaaaaaaacttctttagtacttatctatactgattatactacagaaattccatctcctgtttcccccttcctggggacatttggcaatgtctggaaatactttttggttgtcataactggaggggtgctatagggacctagtgagtagaggccagttatgctgttaaacatcctacagtgcataggacaagcactgctgccgctactccccaacaaagaattatccgactgaaaatgtccattaagaaaccctgttccactgtgtggtggctcacacctgtaatctcagcacttggggaggtggaggcaagtgaatccgttgagcctaggagtttgagaccagcctgggcaacatggcgaaaccctctatcttaccaaaaaattaaaaccaataaaaagttagccaggtgtggtggtgtgcgcttgtagtctcagcttacttgctacttgggaggctgaggtcagaggatggcttgagcccgggaggcggaggttgcaatgagtcagtgtcataataccactgcattccaaagtaggtgacataatgagacaccatctcaggaaaaaataaaaaagaaaccctgtgcttgggcaatacctagaaccttagaacacatgggtatctcgttataagagaaacctgagctcactttatccctggctacattctttcatacccttccaagctccatgcccaaggagggtagttttgagctgataagattattttattcctaacttccctttacctacaaatagacgttactgtttcgtttccaaagaaaacatattgccttagtctgacgtagtacatgtcacgggtggaagtcttttgggttactagaaacatttaaaaataaaatctcttactaaaattgaatattgtcatttgagataaatcctagctaccagtaaattcacttgaggaattgctggatattttgccgtgctatacctttgatttctatgtatttaaaccaaatttttagagattggctcttaagttttcctttgtgatttgtgaaggtgttaccagatatttttagaaaagcaacaaatatacaattactgtgccatactatagcgtactatactatactataccataccatactgtgacatatactacatacaaatgcagttagctctctgttctgcatctgtggattcagccaactgcagattgaaaatattcagggaaagaaactaaaaaataacaatactacaataaaaaatacaaataaaactacagtgtaacaactaacaactatatgatatttacattgcattaagtgtaagtaatctagagatgatttaaagtggatgggaggatgtgtataatttacatgcaaatactgtgctattttacataagggactttagcacctgcagattttggtatttgagggggctcgtgagtagggggtaggcaaggtcttggaactaatgctctggggataccaagggatgactatatgcgggaaaacacacagagatatatacacacatcatgcgcatagacagagctatatattatactaaactacttttatgcttttagaagaagtaattttagatcttcaggtcacatgtaggtgattacaaagggacagcggaaataatccagatgttagactacaacagaaaatttaggatgctgtagtttagtcactcaaagactgggaagtaatgggatcagagcatgaataagatgaatgtacatgtgttcaccagttagaaaaagaggatccttgtagcttaataggtactgagtttgagataaatgaaaggatcatgtgttaaaaacttgtaatcttatacttacagactacctattttcaatgtaaaaacctttttctgacaattcaccctttttaaatttcattgaatatatagtatcgtacttacactttcccggaaataatcagccagaggacagtgattatatacgtgagtggtatgagtagtgcaatacaaagttattcagtgtgatccactgcaaatgttcagtttttgttgaagttcttctatgttggaatttcatgtacatttcataatcagtattgtaatacacctatattaatttttatggggacatatctctgctccattaaatcttcaagcaaaattgtgttcccaaagacacattatagcatatttcttctcatgagaaggataagaaaatgtttttgttttggaaaatgcagtcaggtgcagtagctcatgcctgtaatcccagcactttgggaggccaaggtgggtggatcacttgaggtcaggagtatgagaccagcccggccagcgtggtgaaacctcatctctactaaaaatacaaaaattagctgggcatggtggtgcacgcttgtaatcccagctacttgggaggctgaggcaggaggattgcatgaacccgggaggcggaggtggcagtgagccgagattacaccagtgaactccatccggagtgacagagtgagactccgtctcaaaaaacagtaacaacaaaaatgctcataaggtgggcaactatacacatatatcccctgtcccttgatgtctttctttattattagtttgtcttttactagtctgtcaacatctcaagataatgcaaagctaatttaagaaaaattaaatatggcacttggttatacctaaggattgtgtagggtatgtagcatagctgtcatgtatatcggacatgatttttaaatttttatttattatttttttttgagacagagtctcactctgtcgcccaggctggagtgcagtggtgccatctctgttcactgcaacctccacctcccaggttcaagcgattctcctgcctcagcctcccaagtagctgggattacaggcacccgccaccatgcctggctaatttttgtatttttagtagagactgggtctcaccatgtttgccaggctggtcttgaactcctgacctcaggagatccacctgcctcggcctcccaaagtgctgggattacaggtatcagtcactgcggccggccaggcatgatttattaatcttgtaaatttgtcaaatcgtccttttgaaaaatattaacagattggaggaggggacatttatatataggattagtttcttctagtttgtacatggtacatttatttcagtctctataattagactatattatctattagaaatttgaccacatagagcaaaaaccattctcagtagattaccactaagtagactactgaccttactagaaatagtcagaatcttctggttttattgtctgacaaactgttaaaggccttaccttagttgtggtgaaacacactaattttcagttagggctaaagaaatctgaaagtcaattttaaagtttgtagctctccttgtatacttcttatattcaaaacatgtaatgtcctgcttattttattctggaagtcttttaacatttaagtatttatttaaggtgactttgcgtaggtaataacttagaagttggatatgcttattttgttttctgtggcctttaaaataatgtaatttttgttttttattatttagggatggtaggatgctctttgactacctggcggacaagcatggtgtaagtgttttaaaaatattttaaagttgtcatgttttaataatgctgactaaagactggtttgtacagatgagcttatggcttggcctaagaatataatttccagattaatttattaattataaaatctggttatatttttaaaacttcagtgtttataaattgttgctgacaggaaaatatgtgcttatagctcacctttagatgacagaaattctcaaagcttgtatttattccagagttgtaatagttggcagtaattgttggcattttatattagtgccaatagcaagctaagtattatatattatagggcataggatgccttttcttatggattaacgagtaaggcaaacagaattaaatttgaattagaaatgctttgagcagtagaattaggtagtactttggctgccttgtggaacacaatagcctttgaaattatcaaggtctttataagtccccagattcacaaataaagaaacatcgtaagctttcctaaccgtcactcaatcttatttcccttgtgttaactcaaagcatgaggctttgcatataattaattatttaaggagtccccaactcccaggtcatggaccagtaccggagggccacagagcagatgatcagaaggtgagcaagcattaccatgtgagctttgcctcctgtcagatcagtggaggcattagattttcataggagcacgaaccctattgtgaactgctcatgcaagggatctaggttgcacgctccttatgcgaatccagctagtgccttgatgatctgaggtggaacagttcatcctgaaaccacctccccgaccccagcccccattagtttacttctttaaataactccagaggtcagttctataaaagtctcccaaaagctgccaccaaaaataaataccataatcagagatacatttgactcataaaatatacattagaagttggtgacttaaacattcatagttttgacctcaaagacttatgaattacaatggggttttaaaactctaaattaaagagaacttaatcttttttttttctttttagtttaggcaggaatatttagatacactctacagatatgcaaaattccagtacgaatgtgggaattactcaggagcagcagaatatctttatttttttagagtgctggtaagtataagtacatgttttttttttttttttttttgtcttttgtaggattcccttggttcttcaaaacatgtatatagatagatttgggtctgttcattaagttttcaacagtcattggcaaaagagaaaaaagtaaagaaaaccctcccactcaaaaacagaaactagaaaccttgtttcagggcctcaaaatttggagggtgatttaacttgtccttgaaatccaaaagtaggaacaattttatgatttttagcattaacagaatcgtatcatgtaatggatttattattataatattatacagcacagtgagtggcacattgtaggtgcttaattaatattgttgagtaaatccattattcctgatttaatactttatcatatatatatatactccttgaacttggctctaaacaactgtggaatcctaacggtatgtgaaatattttatgccttagtagtaacttttttccagttacctctgccttcagctattggaatataaatatcaatggtttcttcattacgtggggtatagatgagtttaaatggtactattaaccatgaagtatcctattaccgtatatttgacaggcttctagatttagtgcttttgttagagaaggagagttgtgtgaagccaaattaaaaatcaggccttggccaagtgcggtggctcacacctgtaatcacagcactttgggaggctgaggcgggctgatcacctgaggtctggagtttgaaaccagcctggtcaacatgttgaaaccctgtctctactaaaaatacaaaaattagctgggcatggtggcacgcacctgtaatcccagctacttgggaggctgaggcaggagaatcccttgaatctgggaggtggaggttgcagtgagccgagatggtgccactgcactgcagcctgggtgacagaacaagactccatcaataaataaataaatatatatcaggccttcaaattgatgtacttcgttctcactctgtcttctgtttaggaaagtgtattaagtgccttctacagttatcaaaacatccttgtattaactagcctctcatttgagaaattataatttgttaccttggactagtaagtaggtacttaaagtctaagatttcttttttttttttttttttttttttttgagacagggtcttgctctcacccaggtaagagtgcagtggtgccatcatagctcactgcagccttgaactcttgcgctcaagagattctcttgcctcctgaatagctaggactacaagtgtgcatcaccactcatggctaatttttaatttttttttttccaagatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggaaaaagaccttaaaacagagactttttgtcttccaaccttggaagagtttgtttctttttgcctttactttctggtgcttttttcttcacttgtagctccacatgttgcaaaataaagtctcatggctgctgtctgtggttattttctaggaaattaaaattttcattttgtggggagggagagattagtattactgattcaggtaatttctacacttaaattgcatagacaacttcactttttgaaactccaccgtcctttaaagaaaaagattttctgtttatttccaactttgcttaagaaaaacaactttttttctttcttgcttccatttgtagatgaattcttaatttacagattagctgtggttcacttgcaagtgcattgaaggtaatcagtgatgctaaacttgtagtaacttatcaaaaaattccatcagttttactttgaatattacgagggatttaggagagcaaaagttgattactttggaaatgtaaacagcttaaacccggattgtaaaatcagaagcctggtatgattacaggtacatgaaaagagttggttatttatatcatttgttaatgctgggagtgaattttgagaatgaagatttagtgtcatgttagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtatttcattctgtgaatttaccatggtctgtttaatatattcatctattgatgatgaacatttagattacttttcgtttttgcctattaaaaataaagttagtatgaatatgcatgtacaagttgtattgtggatatactttgtgataataactagaaccaggagtggttcaaaatttaatttacacatctactccctgtgttatttgcctgctcttagtgtgccaaatgttatttagtacatttgaaaggaagaatctcagtatagactgagtttgtattgtggtccccaatgtttagatcatatatctgtaaatatgtatacacatttacatatagataaatataaatttacgtatgtaaatgtatatgtaaatatatgtaaatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcatcttgaggtgtagacatgtattcttccccctctactgcccttacttgcttctattgctttagcacatctgatcggttcagagtcagtttacctacttctgctgctttgttttgagggagtccagctttgctcattgttattagcctggtcattatggatgttttgagtttgtgactcttttaccagcggatagaagaggtagggatggcccttagtcccctctttttttaggttaagactgtggtgtaaaatttataggtttcatgattagaagtgtaatttggggcaagttacactctatatgtattagttcccattttgaaatggggataaaaaaatatagggtttttgttaggattacaggagaacactaacttgtattgctcagtacataatcctttgataactattaattgttaatcagtgggcctgcttttttcctgtctccctctctccgtactgacttccatttgtgtcataatttggaaatattttttggttctgtacataatttctcattacattgtaaatgagactcacgtgtcttgattttccacatcttcatcctagtgattttagtgacaaattacatgtaaatctaacttggtttctgaagttttaggtgcctgaaatttgattagttatgtataaattatctgaagtgggttatagtaagatgatgctgctgtttcctagttataaaagttattttttattttcttatctagactgattattgaagacctgagtatttttagcaaaggttttttgaaacaaaccagtgtgatccaataaggacttagataattacagttttttgtagaaagctataggtcttttagtaggctagagggatacatgggtataaaacatacattatgttcatttttcaagagtattcacaatataattaattatgatttcttaaacaggttccagcaacagatagaaatgctttaagttcactctggggaaagctggcctctgaaatcttaatgcagaattgggatgcagccatggaagaccttacacggttaaaagagaccatagataataatgtgagttcgactttttcacagttattctctgaaatatctgtgtatccttcacactttctgatgaggaaaatcactatgcattttgggaattaaaaaaaaaaattcatattagcttttgttgaccttacaaaaatcatagtggattagtggcttgactagtttgaatctccttgaatgaaattgtcagacttcttttggctcttagagaaaaaacgtagccttcatttctgttttacagctactgtgccctttttttctatgccagtcaaaatgacactatgctgttagtgccacctattattgaaagtcctatgcagaagacagttttcatctacaattatctaattaaaccacttactatgaaatgttcagtttaattcttgcttttaaaatgttttctgaaatgattataatttataacttctgtaagagtttataaattagagcgtcttcagtagacattattgaatctgtctctaagaacagggtaataatttggaatgtcgagggatcatgtagagagaaggcatagggggtcggacattgatcataatgacctccgtgcatgccttagaaggggctcatttttaattacagttttgaagttagtgatgtttgtcctcctgcctctttcttatatattaatattttttatgtatatatttttaaatcctttagtctgtgagttctccacttcagtctcttcagcagagaacatggctcattcactggtctctgtttgttttcttcaatcaccccaaaggtcgcgataatattattgacctcttcctttatcagccacagtaagttatttcactgtgtaattttggctttgtttagataaaattacatggagttgtttaaacttaaaatatacttttttctatcatttgaatttgttgtcacctgtttttttttttcttcatgtagtagatttgcttgttactgaaaagtatgcatgtgactcttaagtaaactatttgacagagtgtaccctaagccttttaaagtgctatttaaagtgtggtccctgggccagcagcatagaaatcatatagaatctcaggactcaccctagaactaaattagaatctgcattttaataagatcccaggtaactcatgtaaacatcaaagctttagaaatgaggctctagggcatactacttgaaaggaatacgtgcatctttttatatcatctttgctctgtcaactagcttttgtttaatattttggtgatgagaaattcactgcttatgaactagaccattcttttgtaagctagaaattatttgtaaaatttactcttccagtggaactcaaatacctctgaaacttctgcccattatttcttgtttgtttggaatgacagaaaacaagactgcttcatggaaactctttagatgttttaagataattttttactcctctctgcttccttcaggctaaatatctctagttttattaagtaacacagtttttcagaccctttagtattttgattgcctttttagataatttctattcatattcttacaatctagatgttcataattgaaattttattctaggattgtcatctaaactttatagattacagtggcaatattagctcatgttacttgtatgtatgcttttactaatatagcctaagattgcagtagcaattttagcagttgcttcatggtatgagttatattgtattgactatattattgggcaaattttacaataacacttttttttttagataatgtctggctgtgttgcccagactggagtgcagcggcattatcttgcctgactgcagcctctacctcccaggctcaagccatcctcccccgtcagcctcccaagtagctgggactacaggcacatgccaccatgcctggctaatttttctattttttgtaagacagggtttcaccgtgttgtgcaggctggtctcaaactcctgagctcaagcagttctcctacctcagcctcccaaagtgctgagattacaggcatgagccactgggcccagccctacattaacagtcttagttcatacttttactatttgttcatctaaatgaagattttatagtttcattacattttatcttgtagaaatgaaaatggtttcatatgacaaatgaaataataagaattctaaatcattaggaaatactatatacttggctgatatcctccaaaatctgaaataccctgtgtggcattatcagatcagttaactgagggaggaatcatggggggttttgctttgtttttaaatgattccattaacaggattatgggtcctgatgaatgtattggtcagtatttaaaaagtgtgtgcatatgggaatatatcctaactttgtggggcaaaaaatcccttatttgaacatccagtaaagccttcctcctcaaacattaaagttagatagatatacactgaaaagccattggatatttggaaggaagagaaaaatgatattaaaattatatttgggagtatttttaccagccagtgcttcttaaacattttggtcttggaacccgtttacactgttaagaattattgaatgtaggccgggcgcagtggcttacgcctgtaatttcagcactttggaaggccgaggtgggtggatcacctgaggtcaggagttcgagaccagccatggtcaacgtggtgaaactccatctctactaaaaatacaaaaaattagccccacgtggtggtaggcacctgtaatcccagctactcagaaggctgaggaaggtgaattgcttgagtttgggaggtggaggttgcagtgagcctagatcacaccattgcactccagcctaggcaacaagagtgaagctccgtctcaaaaaaaaaaaaaaaaaaagaattattgaatgtaattttctttgcattggttttatctcttggtgtatacagtaagtcctcaatattgtctctaggttcttggaaactgcatctctaagcaaaacaatgaataatgaaacaattttctttctcaacagcttcataatgaaagaatgttacttggttttaaagtcgtagtttccaagaaggtaccgattatgttaaggacttaactgtattaaaaatcaaaacaaattaaaaattttctcattaataaatggtaaattgattcaatttaacacataatagaattttaacgaaagtaactttgaaaacaaaattagtgagaagagtgacattgctttacatttttgcagaccttcagttgctgggttaattgacaactgggttttcatgcctgctttcttgcagtctgttgtgatgtgctttaactgtaggatgaaaaacctagcttcacacatgtagttggaaaagaaaggtgtgttttattaataatatccttttccgataattgtgaatattcttttttgaagatacagtaaaattcagtaagaagtacagataaaataaaactcaacaagaaatagtttttaaaaggttgtttgtaatgtagaatctgaaaccatgtggttaaactttttgggatcctaagctgtactggtattctagactgtattgagctatcttgcacttggaatggatcttttttacccatgcatgattttatagtatcattcattggttgtttgggaaatacttactggtccagtgagttatgcaggtattccagtgtgttgacattatacaacaccagaaaaaccacattcatgaacatcactaccagacccatagaaacgggtttaagcattggaaagctttcaagctcccagtggctgatacaaattttccaaaattctagtttttcttgaaagctctaattttatcatttgtttttcttgaaggacaggctcacttcattttctagaaaatgtctggcaaattcccaagtctgaatgtctgaatagctttagtttgtctgccattctttcaagtaaaaacagtgttctgtgagaaaagcagctggttcatcttgtttctcagttgcacaagtgcttttccttaaggacagccgtgacagtgaagtgtgtatacagcagaagcactttatgaatacttaccatttagtcatacagaagactagaaagattagtacttaagggttgaagtttttaaaaattaatttgggctacgtgattcaaggacatagttgaaactttttgtgtgttttttaaaactgcaaaagtgtggtggtgaaaaatatagggactgctagtatagtttgatgccactgctttgatttactctaaagtacaagaagaatttgtttgtttatagtttagtaatttttagtaacttaactgagtgatataaccatcacaagtcagttttagaacatttttattgccccagtaagaaccatcatgcctgtggaactattttctttgaacagaaacagcctgtggaaaagaaaactactcagtagtatgatgacttttagttgtttacaaaagtactgtgtttactgttttcacttgctatagggtcagattgctgtcttattttctgtcttgttaagtcttcttgcctgattttgatttttgcttgattctgacttttttcctaatggaaatatacccagttgacttgacagatcattgtttcacccatttcctggacttcatattcttgaagtgggagagctatttactgttgagattgtgtgtgatttgcatttgtatatctataatcagtatgtgtttttcagttgtctctgtttaagatttatgaaaaaagtagttctaatttcttatagcacagtaggtagttggttgattgcatgttcaatggatattatatgtagattgtaaattgcatatttttaaaaattattttatttttattttttttgagacggagtctcactctgtcgcccaggctgaagtgcagtggcgcaatctcggctcacttcaagctctgcctcccgagttcacgccattctcctgcctcagcctcccgagtagctgggactacaggcgcccaccaccacgcctggctactttttttttttgtatttttagtagagattgggtttcaccgtgttagccaggatggtctctatctcctgacctcgtgacccgcccaccttggaatcccaaagtgctgggattactggtgtgagccaccgtgcctggccatactttttatttttaatataaaagtacgttagagatcatgtatacgtttgtccttaaaatgaaagtttagataccagtgcaggttaaagtctcttacatcacatatattaccatttctgccataatttattctgaatctaaaatggagatgatttacacatttgaaaagtgttgaacttttaaatgtaacataatatataagataaggtggcaggtgtaagatagagcagtgttcgtaggctatcggagatgaggctttgccactaaatgtagatgctgttaggaaaaagaatccatttgtaatacaatgccctattactctccacttgtagaaagaaagatgcaaagttcagttagtaaaagagtattttgttttctcaataaaaataatctgaattttctaagaaatttcaagttttactattaaccaatccactatgtgatgtccagaatttgtacagacagacctttcctgctgttattttccttatattttctaattagttcctggtaaaaaaaactctttgtcgtgcagatagtttacctgctttagctcactcaggatgacctccaaggtcctcatctggaggtctacttagtgtcctacctgtgtttttgtttttctctttttaaagcctgtccttcatgaaatgcacttccctttttgttctttcttgtccaaaacctatctgtttttaaggtccagctcagatttacttccttcgtgaagtcatttcagtgtattttgtttagcttgtatttggtgtttagttacttaaagctgttaaaataaacaaaacttataatagcttcatctccccaacttgtaagcatagttacagacagagttgtcatttttcatgttcttgtagcacatagtagatacttaagtatttttaatttggtggcatattttatgttttgattattaaattttctgtgtttaattatgaaacactgtaggaaaactcccataaagctgtacagttggggaagattgtgctagaatgaaaaaataaactaaaacattttacttacctagcttgaaatttcacttcatagcacaaatactgagtctgttatttaaaaaaaaaaaaaaaaaaaaactaagaaaatttgatttcaaaactatgagaagtatagcctgctattacacagcttagaattcaaacgagtaacataataagtaatacaagagcatgtctaataagtacatacagtggtattgtacatgctaaatactggagaagttagaagcatccagtccttgaagataaaaattgatctgtcttaaatttggttggacagagaagagagataagccagggaagtaaaacaaaagagcacattggtcattggtaggctaactgttaaaatatatacctgtggttttggtcatgtttgaagtaagtttttaattgctgatccttcaagaatgtgaattgagataacaaaataatcacctctaatctccactcctattccttcctctccttatctatatatagatgcatacacacctaaatgtttatatacaggatggatcacttttgccctgtaaggtagggagtctgccatgtttcaaagtctggctgggcatggtagctcctccctgtaatcccagctacttggaaggctgggacaggaagatcgcttgaagccaggggttttgaagcctgcctgggtaacatagtgagacctatctctaaaacatttttttagaaattagctgggcattgtgattcactcctgtggccccaactacttgggaggttggggcaggaggatggtttgagtccaggagttaaaggctgtagtgaactatgactgtaacactgcactccagcctaggggacagagtcagattccatctctaaaaagtaaaaacgcctggagccatggtgatactgtataccaaggatctgcaaactatggaccatgggctaaaatctggcccacagcctgtttttatatgtctggcagtctagaatggctttcatattttaattggctaaaaaaatgtgaaaagaataataatattttgtgatgtgaaaatgacatgaaatttcagttttagtgttcataactttttattggaaaacagccactttgtgtgtgtgtgtgtgtgcgtgtgtgtgtagtctggcagcttttgagctctaatggtagatctaagtagttgagacagagatgatatgttgcacttttgccacctcatactcttctcagtttactacaaatccaagtgatgccagttatacctggacagtgtttctcaagccccatattgtcacactgcaacattttatttatatgttattttattaccagtgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggcatcaaaatttctagcccagagcattgcctcatgcccatagccctatcacttaggctaaggcaggaggatcagttgagcctgggagactgagtagtgatcatttcactgcacttcagcctgggtgacagaatgagaccctgctctaaaatttttttttcagttaagtgtctgaggggttcttttcttttctttctttccttttctttcttttcctttcccttttcttttcattcccagttctttttctttttcttttcatcctgtcctgtcctgtcctgtcctttcctgtctgtccatgtctcgctctgtcgcccagtctggagtgcagtggtggaatcttggcttactgcagcctcggttcactcactccctgggctcagatgatccttcctcccaattcagcctcctgagtagctgggactataggctcacaccactacgcccaggcatgtgtagtacttttatcagccaagtaaggaaagtcatttaccagtggtgatccagttaaaacatgtttgattttagcagccagagaaatctgtccagtgaagtaaacttgtttaaaactattaacctttcagcgagaacagttgctctgagttgaggatattgacagcatgttgatctggggagagattgaaagtgcccccaacccgttatcaaacactgaatggctctggaagttaacttttgcagcagacttgataatgtttcttagtttgtgccatctaaaattgcaaaacaaaagtgtttatatgtagaatttatattgcagtaaagtcatttcagtgacaacatggtatgaatcataagtaataaaaagccagctgctttacacattttgtgttctgtcagaagttaaaacacaaagggagaccttcattgctaaataggattgtagcagatgcatttccaagttcaaattatagttgcagaaagttttagacctcattgcaagtatgaaggaaatttctatatttcaaaatttaactacagttgaattgaaagtgattaatctgcaatgtgatgacacgctaaaagataataccaaaataatagaattgtacatgtctttctaaatgtgctcaattaaaataatatgcttgtcagttggtgtttgatgtcagcatttactagtgcctgtgcatgtttttacattttccttttttttttttttgggagatggagtcttgctccgtcgcccaggcctggagtgcagtggcaccatctcagctcactgcaacctccacctcccgggttcaagtgattctcttgcctcagcctcctgagtagcagggattacaggtgcctgcctccacacctgggtaatttttgtatttttagtagagacagggtttcaccgtgttggccaggctgatgtcaaactcctgacctcaagtgatccacccacctcggcctcccaaagcactaggattacaggcatgagccaccatgccccgcctacattttcttttttctttctttttttgaggcagggtcttgctctgtcacccaggttggaagtgcagtggtgcagtaacggcttattgcagcctcgacctcctaagctcaggtgatcctccacctcaattttattattattattttttgtagagacaaggtttcactatgttgcccaggctagtcttgaactcctgggctcaagcagtcctctcacctcggcctcccaaagggttgggattacaggcatgagtcatggcacctggccgtttttacattttcaaggactaaatatgtaaaatctcattacagattacattatcagaaaaacatttgcaatactttttaatgatatggacctctaaatttgaaattaattaagcaaaattattcccagtgaaagaattccattggtctcattagcagacctatattttggaaatttgtttcctctctttttatagaagtatctggcataatattctgaatttgcctcttgcccacaaagccaaaaatgtttactatctggttctttacaaaaattttgctggcttctgaaatacactcacagaaacaaagagtagatttcccaaataagtaatcctccagtaaaaataattaagatgtatatggagcaatggtataaactcaggataagtaaaaataactatgagttgaacacactatacaacaaacttatagaactatttatgtataaattgattttagataaattaatgatgagtctcataaacgtgcactaaaatgacctactttgtctgagtggagtggctcatgcctgtaatcccagcactttgggaggccaaggcaggcaggtcacttgactcagcagttcgagaccagcctggccaacacggtgaaaccccatctctactaaaaatacaaaaaagttagccaggtgtggtggtgtgcacctgtagttccaactactcgggaggctgaggcaggagaatctcttgaatctgggaagcggaggtttcagtgaactgagatggtgccactgcactccagcctaggagacagagtgagacttcgtctcaaaaaaaaaaaaaaaaaaagaaataaaataaaaaaataaaatcacctactttaaaactgatagtaagagaaacaatcatgctttcctgtgtttgtacctgagctctctggcaagagaagtaattgttctaaatgagtattgcaatacaaaattttcatttctaactcaagcttaatttttcagatgatgtaatttagccagtgtgtttttggtgtcttttcctagaaattatttattcttgagtggatattctttttatacttcacctcgtttagagggcattcagggtggctaagtgggactagatattattaagtgttcaattctagggtcctctaaagagtttaaacaacattttgtgggaatctataatataataaaatacagatttactcatcattgcctgggggaacttagaagataaggtattgaagctggaccttgaaggatggctaggatttaggctttcaggggtatgtatttgggagaccaatctgtgtggagtgaacttgaagaaaagagagaggaagctgtcaatggtagtgtgatgggagatgtagctggatggataatttggggcttgaatattcacctaaaagaaatggactttattgacagataattctgagatatgtatagtgtctggccctcagaggtgctaaattagtatttattgggtaaataaatagggagctatttgaggaaattaagcaggagaaataagggtaaacacctaattacagggcattgtcccatgttgatcatcacaacagcaagatttgctaaatattagccaagaccctgttaatgtttacctgacatctattccttcctaattcctactgctaccactttaaccaatgtcttgtaatattgtaatattccttccccgttgcttccagtctttcatcccctgaattatttaatttaagtggctgattttctcattagtatgagtgctttgcacataggttttcacacatttttttctaatgggtgaatgaaagtcatcgcttagtagccttttggaacagactgacagcatgtcaatgaaccttgcaaaatcctgttactcaaaaataataataggataattagcctcttgattgagtcttccatctcaccccatattaaagaaatagtggctagcattctcctcatttggattcctgaaactggattctgtttttaaatttccttggaggagattttcttataatactcattcttaagtgtttgcagtcttaggctagtgaaatagtacaatctaatgacctgctcgagagttttctttatctcaccctgggtaagttattaaataacttttatattttttcttagatatcttaatgcaattcagacaatgtgtccacacattcttcgctatttgactacagcagtcataacaaacaaggatgttcgaaaacgtcggcaggttctaaaagatctagttaaagttattcaacaggtaaaactaaaatatatattgatttttttttttaaatacctaagctttaggtctaacctctttttctaaggtaagacttagttcttaaggtacaaacgtttttaaaaataggtggaaggaatacttgaagtttagaaaagagaagaccctcaaatgggcttttgttttccttaagtccaagatacacaagttggatgtggtaggaatgattattactgtctgctagatgaacacttaatatatacattatgtgtatgtgtttctcttattgcaaagagtgaagaaaatctggaacctggaggtgggggtcattacctgtgtaattctacatgggtgaactttatatacaataccgtttcaatagaccccaagttgggcaaaaggtttcaggcagccatgctgattgatatttagtgagcttgtcagcaaaacccgtagattagaaatataacttaaatatttatttaagagtgtattaaatacaaagaagttattgtcattcagtagggaatgaatacccttatgattggggaagtttattactgtttattgaccaagggagacttttggtagtagaggaatttgaaagctttcagaatgcttctaggatgagactttagagaacttggtttgaaagacataataagcttaaggtgtggtctggaatcaggataggaacaattgttttgggaagatgctaggtaatttggctagaaattaatggtaaagaaggagaaaacaagaagattgggatattctggggcaatctgctaaacaatgttgaatcagacttaccttgaccgttgacttatttttacaggagtcttacacatataaagacccaattacagaatttgttgaatgtttatatgttaactttgactttgatggggctcagaaaaagctgagggaatgtgaatcagtaagtgtgaatttttatttataaactaatactattcttaaatttttggatattgtaacgttaatcttgcagtgtcttccttaaagtaatgaagtaattataacggaaatatgcttattaatcttaaaaaggcctaaatggctcatgtttattaaccttaaaatggcttaaatggcttgtgtttattaatcttaaaatgggaatgtgctagagtgatgacttttttaatgttgttgccatgtgtttatcccttttgtgagggagtttgttaaaacattgggggtaatttaaatttacagacatatccataatttcatgtcttaaatctcgaatgaatatttttaatatttcatatgtacaggcaaggtcactttgaattgcaaataacaactgtgtttttaattttggttcatagatgggcttatctttagaatatttcccatggttgtatttaacatttgtgataaaccaggcaattcattgtaattacgaattttataacggcggtgtctcttattgtttagtagaaattaaagtacctttagagcaaatggaagacttatagttgttttgaataattagtttacaagttttaagaaactaaactaagaattctaactgctaaatgtagttgcatttaccagattcacaagttactggttatcagtttcacccttggaaccaaaattttggcacaaaatgggcaatttgttgacaaatatcttacttctctaaggaaaaaaatgatcatgcaaatatccattccctgatgattttcttattttattttttttcagacagagtctcactctgttgccgaggctggagtgcagtggcatgatcccggctcactgcaaactccacctcccgggttcacaccattctcctgcctcagcctcccaagtagctgggaccataggcgcccaccaccacgcccggttaattttttgtatttttagtagagacagggtttcaccatgttagccaggatggtctcgatctcctgatcttgtgatctgcccacctcggcctcccaaagtgctgggattacaggcgtcagccaccgcacctggcctccctgatgattttcaaacattagatggaatagaaaattagaatccaatatggtaattggtgtttttttttgtagtcatatattgcattattaaggtaaatattggcgtatattcattatgctaagtgtctaggttttgatgttaaaagacctagagggtacttggttgctgttcttgaaattaaaatattctctcttaattacaccatctgtggaatagtagccaccttttgcattcttttccttctaatttctaagtctacttaatattgtagaaatactccgagcttgtagtccatttataattattttaaatagttggaagagataacattatctgcagagcatttatgtagaataatggatagtaccaaactttgttgtcagaaggctactttattaaagttatcagaaacattgcagtttttaggtctttatcttgtggtattcgtttactacttatttaaatcattaaagatttgaacacagtgttctagaaagtgctgtggtataaaactcatgattgtagaatggaaaaataaagcagataaagtatttgattcacgtttcaggcaattgcttgtcagcatcattaatttttgttgtatttgtacatataggtgcttgtgaatgacttcttcttggtggcttgtcttgaggatttcattgaaaatgcccgtctcttcatatttgagactttctgtcgcatccaccagtgtatcagcattaagtaagaacaccgtgatttgatttggattttctactttaaaattcctggaaatttccatttattgtgaatttacacttaatagaattccagttaattggatttttatttatttttgctttcagaagaacaatgaaacaatttgataaaattatttaaaaacctaacttttgctacaggctcagatagttttagcttgagtggcataatttttcaaaatactaagttgaaggcaatatatgattatcagttaccttattgaagagtaaatactcttgtacctttacgtaaggagaaaagtgtagtaaacatttctaaaatggttttcaacaacagtacaaaggagatacccattaaattggaaattctgttgaaagaccactacatttggtaatcctttccatttagtttgtatgatttaattacatatttgacttctcctatagtaaactcctatggcatcttaaaatgttgaaagatggaaaaattatagtgaattttagttgtaatttcctgttttgtcagaaaatattgggaaaaaattgtgaaatgtacataacctattagaaataaattgtacacattacagtttgaaaaatgactagtgccctttgggcacagaggaagtcaaacaaatgtttaaaaacctactgctttagtgtttgcttctgaggaattgtgcataaaacaaattctttttctttaatgccatttgtttttgcttatccatacttcgcttgcctaattttagtgggccgtccgttgaagtggttgtccagagttagaaggatagtataatcatgggatttttcctatgggaattgaatccttgccttcacagttttattagcactttactgtagcttgcagacagaattttttaaacctgattctcttacaaattacatgaaaattcctaataatgtaattggttatgaaataaagaggtaggtacatcatatgtggggctccggtggatagtagtaactgaattcttgcattgttctttgtttttaaggtttgtaattagggcttgtgaaagagggatgttagtattttggtttcccttgtagaattttctccatttctcattagaatgtggtcatttgggtgctttttggtccagaactgacttagctactaccgctgttgtgggccttttgaaagctgacccttttttttgcatctttagcacctaacatactaactttgtagcacctaatatgctttgtacagtatagtgtgagtatacaatataaatatttgttaagtaaatttcttctgttattagtgaacttggcatttttgtccatgataatgcttgtctgctttggtgtttgcttccgaggtactatcaataagatttgttgtagctcttttcctttaactctgcagccatgtattcattattttctttcttgggatttggtttattatcttttaagaggaacatagattaagtatgtgttctccttactgaagggagatgtgcagctcaaagaagttaatagagtgggaatgtttctatatacctttatgtgacactacctaagaatttttcagacttttctccgtgtagatttttattacttccttgatctctgtagttttctgctagacaaaaatctacaaagcattttcagactaaagtcctagtggctttccagagtctaaaaatatttttttttctagtagtagcattttctttcacttcagttcttcaatttttttttcaatgttttactaagatgattaagagtacatagatcaataatgtatgtttttctttttctttctttttttggggggagacacagtcctgcactgttgcctaggcttgggtatagtggtgcgatctctgctcactgcaacctctgcctctcgcgttcaagagattctcgtgcctcagcctcccaagtagctgagattacaggcatgtgccaccacgcccagctaatttttgtgcttttagtagagatggggtttcaccatgttggccaggcttgtcttgaactcctggcctcaagtgatctccctgccttgttctcccaaagtgctgggattacaggcgtgagccacttgcgcccagcgttttttcaagtactatggtagaattttcaatctgaaagaaatcttagggatcttctgatccaacaacacagttacttttcaggtgaaggacttctcagtagaattttctgtagtgatagaaatgttttatatctgaaaatgtgtttctatgtgttcagtacagtatacttcatagatggctcacatttcaagatcttgaagtatggtttccaaatctctgtgtgacagtgggacttattttcaaatgtaatatcatatatatgaatatatgtatttatatatgtgtataagcagatcaaagcagagcccattcaccgtgcctatcttacagttctgttcagcttctctcctgactactaagacacctctttggaacacagttttacaaaacactgactcagaacaactgcattgttttgtagccaggaaatttaaagctcaaggacattaagctaggtcttgatagagcctgtactaaaggtatctgacattcattgtactgtacctcactgtaagttcttttatattgtgaacaatttatatttttagaaatgtcaggtttagattaatttgtcatttagtttatcagttgagccagaggataaagatgaaaaccctaagtcactttaactctgtgtttcagaatctttgtagagtttgttttataaactccctatagccaccctaaaccattgaatcagatttattgagtaggctatgctatgatttgcagcagggctgctgtgctgtatcttgagggtggttattccgaagcacagccagaatccaaaaccactgcattaggtaaccagttttttaggcgtgtaattacagcctgctaaagtaatggagtgaaaaatcagtaatttaatacctttattatataatgaattaagaagataagcttcttcgtgtttctaaggatgctttagtgggttagaaagacaaaagaaactaccatcagagtgaacagacaacctacagaataggagaaaatttttagcatctacccatctgacaaagggctaatatccagaatctacaaagtacctaaacaaatttacaagaaaaaaacaaccccatcaaaaagtgggcaaaggatatgaacagatacttctgaaaagaagacatttatgcagccaacagacatatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttgacccagccatcccattactggacatatacccaaaggataataaatcatgctgctataaagacacgtgcacacatatgtttattgaggcactattcacaatagcaaagacttggaaccgacccaaatgttcatcaatgatagactggattaagaaaatgtgacacatatacaccatggaatactatgcagccataaaaaatgatgagttcatgtcctttgtagggacatggatgaagctagaaaccatcattctgagcaaactatcacaaggacagaaaaccaaacaccgcatgttctcactcataggtgggaattgaacaatgagaacacttggacacagggtggggaacatcacacaccggggcctgtcgtggggtggggggagtggggagggatagcattaggagatatacctaatgtaaatgacgagttaatgggtgcagcacaccaacatggcacatgtgtgcatatgtaacaaacctgcacgttgtacaaatgtaccctagaacttaaactataataatagaaaaaagacagtggctggaaataatacgtatttatgttgggattttataaatacagctaacattttaatttggactccaagaatttgtaatccgtgataatgaccaacagagctaaaaattacctttaaacattacacgggaaaaaaagtacttgttctttaagccagaggttttaaacctagttgtacattgaaatcatctggagaagtaaaataacaagaatttagcttaaaaataatagatttcctggttttatcccaggccttctgaatcaaaatctctgtgatgcaggcttgagaatctgggattaaagcttctcaggtgattcttttgcagtcagccttggggaatcattgctgtaaattagtgactttatagtactgacaacacattagaatcaaatgggaaactctaaaaagtaataaacagaaatactatatgactgagcctaacctttaaaaaacaaaaacattctctggagggagaccccatagactgtgttttaaaaaaaggtcctctaagtgattttgatgcaagatctggcttaaaaaaaaaaaaaaagttaaactgtttattttgagatgattatgtatcagttgtaagaaatgataaaaagaccccctatgtcctttactcagtttctcccattagtaacatcttgcaaaaccacagtaaaatatagcagccaggatgttgatgttgatacattcaagatacagaacatttctatcacaaggatccttcaagctgctcttttatagtggtaccctcttccctgccaccctgtccttaatttctggcaactactcatttgttctccattcctatatttttattactttgagaatatgcaaaacattttctaaaagttagtgttcagcttcctaaacggcaaatatgctatgtatcatgattatggtataattaattactagcaacctaactagtagtacagctctccaaagaaaacattacagatgttaatgagtgcctcttttggccaaacacggggtagaaagtagtgagtacactttcaaagaacttaaaatccagaggaagaagcggatattaaataagtggacaaataaatataaagttacaaattattgaaaatatttgtaattttgggaaatttcaaaatttcatatttgaagttacacattattaaaaataggtccatatcattctctctagtcactctgcattggggaacaatgagaagaaaattaggtagggtcagtgaatcctgataactctccaaatgaaatatctttaagccccaaaatagacttttttccactgaatactaactatggcatattattccattcactagtttatgctggcttatttttgcctttaattagtttaaagctatctgatgttctgtcttttgagggggaagggaaaggatatatctcagcttctttttctcccaccaaaggacacatttcaaatgctgaaaatagtattataaaacccataattgtttattaaataactctatttgtaatttggaacattctctgttaatagatttcctgactaaatgcctgtaagcacatgtgatagtcagctttataaaaatgcatattaagaatgttttatatgtttttatacaaccttattgatatgtaggataagttacaaatctgtttaccataaagtttgcaacatctgtcaaaaaagattactgtgttggggtttaatttagtatagctgaatcattttatcagctatggtatgtgtctgaaatttaaaagctgttctaaaataattcttggacgagttttcaattgtagatgaaaacaaattatggaagtaatattttggatgtgtatgataaacatgttggagcatacattagtataatttcccaatgggggttacttaagttttgaagttattctactttgcttattttattaagttatattttagttcttaatatttttcttaaagttcttattaccacataacaatttacatttagaatgtaaatgtatggagacaaacagtttcaaaggccattatcattgcatttctgcattatcaataaggttcagttatttataagattataaagagataattttcagttttcacataaggatttagcatttctcaattttctcctcttttctttgtcctgtttcctcccaatcatacagttaaacatagtttacacttaacactgattctttaattagttgtcttaaactaattagaaaagacttggagtacttttctttggatatgctgaatagttggccagtagtcttcagtgaaaactagaccagaggtttctatatccaaatggttaaatcagcagtattttgaaataaattgtgcctatcagataaaatttggaaagccaggttattcaaagaggtaattaataagacaggtgaaatatcagatccccaggccttatttttccaagtgtttgttaagatgagaggttgggggaagatggtggctatgggagggtttagaaaagtaagaccatttgaaagattaggcactcaaaacctgatagaaaatctagagttgatacaacccttatcagttccctaaattaagacttatatatcttctgtccttaagtgggatctctggtattttttacttcctggaaacaaaaaaatatttccctaaatcaagacttaaatttatcttgtgtccttaagtgggatctctgttattttttacttcctggaaacaaagtatttcattttgtgctagaagcatgaacatgtttaattaaattgaactgaggatgaaagatttgtttttgctttgtcttttgaaatagcacttaagaattctgtgcatatcttatttaacatattcgatgttgtgttttgtgtgtgtgtcagttgagcagcagagctagttaggttaaagatatttataaaggatttacagaacatatttaagtatctaccttaagctgcctacagacaaggttgagatttttagtgtaatctaaataatctagaaatttgggtgtttaaaatctggattggactagatatttttctcagaaattctgcattttgatggattttgtcttttagtttattaataaattgaattattttcagtaacatgaggcaagcatgttctgggataggttacgccaactttttgtctttttaaaattggttttatttctccctagccactagaccaccagggacagccttttaagctttgataggatattacacttttattttaatatctgtagactttgatgatttctattagtccttttttttcctttgcgttttgtagagacagggtcttgctgtgttgcccaggctggtctgaaattcctgggctcaagcagtcctcctgcctcggcctcccaaagtgctgagattacaggcctattaatcatttggtttcttttactgagtgtattttcatgttactgaaaccagattatttctacattctttaattcagtcagagtgataatcagcagcttagataaactgagatgccatcaattatttactagtattccttgggccttatttcaggtttttctttgacctgattcacttcgaaaagtaaagatcaacaaataaaagatcaacaagcacagtgcaaacaaagatccacaaagtaagatatggctcagagcgtgcaggcatttatggatcttgatgcttgttgcaaaattacaccagctatgttggaatgagtcttagaatatggatgtaaagaaagagagagggatagagaattctagttagagttattacataagatggaatttttttttataaagacacaggatcttgttctgtcacccaagctggagtacagtggcgcaatcatagcttactgcagtctgaaactgctgggctcaaatgatactcacaccttagcctctcgagtatctgggactataggtgcaggccactgtacgtgcgtgcgtgtgtatgtgtgtgtgtgtctgtgcgaccatgccagtgtgtgtgtgtgtgtgtgtgtgtgcacatgtgcacagaatcttgctgtgttgctcagactggtctcagacttctggcctcagcctcccaaagtgttggaattataggtatgagccaccacatccagcctagaatggaattttcactctatggtcttaaaaatctaagattaaatatcatttccttaggtaagctgttcccaaatctccagattagaactggtagacctttttgcatttcacatacataggtccttccactttttcttttttctttctttttctttttttttgacatgggggtctcactttgttgcccatgctggaatgcagtgatgccatctcagctcactgtaacctctgcctcccaagatcaagcgatgtttaagtcaagacccccttgacttaaactctgtaaaggctggcaacagaggatgttttgccagtagcatctaacacggttggtattttgttgagtaaatgtcaacaaagtaaaaggattggtttggtttggctggcatgttatatttatgaaggagaatgatgggaacttggaaagttaaaagtgttgaaaggaatttggaaataaactgggtatagtagtctccccttacccaaggggatatgttccaaaacccccagaggatgcttgaaactgcaggtagtaccaaacccaatacagactaggtttttccctgtgcacacataactatgataaagtttaatttataagttgagcacagtagaagattaacaacaacaataataaatagaacaattataacaatatgccagcatcactactcttgtactttggggccattactaagtaaaaaatggttccttgaacataagctctgtgatatcaagacacttgatagctggaatagctactatgtaactgatgggcgggtagcgtatacagtgtcgatatgctggacaaagggatgattcaagtcctaggtgagacagtaggacaatacaagatgtcatcatgctagccagaacagtttacaatttaaagcttatcaattgtttatttctggagttttctatttaatattttcagactgggattgactgctgataacagaaaccacagaaagtggaactacggataagtgggaactactgtagttgggttgtagaactaacctggcagatgtgtaagatagattgtagagactcaagaggtaaagtagttagaaaactaagaaatagtaatggagcctggactagggtagtgactagaataagaatcaatcagacagtaaatatttatcgtctcctgtgtatgaggagtcatgctgctaattgctggacataacggcagtgaatgaggaagatacggtgcgtgcactttggttacatgtatacggtctaccttggaagcagatattcagtaaaacaactatagcaaaaataggtgctatgaaagcacctaactgatgtatcacagatgggagaggtgtcttagaaggcttatgagggtcttattttagctgagacctgatagcttccatgaagataaaagacagtatataaacacacatacatacatgcatgtatactacatactcttaaatattttacatgcatatgtaggtactcttccatcagcggaactgacttaacctatttactaagactggtgtgtttttaattctgataaattaagctctgcaatggccctcttcaacctgatcataaaattggaaaaatacaaaatgcagattggttgatatcaaagagtattttagatcaagatcttcatggtctggtctgctccctctgtctcttttatctgaaattcagtctctctctctctctctctctgtctctctctctctctctctctctctctctctctctatatatatatatatacatacatactatatatagtatatagctccagggagtgcccccacagtttatagcacaaatatacacaatgcccgtcagttttatttatgttttcctgagattatacttattactgatgctctttatagtaggcttacttttttaaaaattttatttcagtagcttttggagtacacgtggtgtttcgttacatggatgaataatatagtggtgaattctgggattttagctcatagcttagctcccacttataaaggagaacataaggtttttggttttccactcctgcattacttcacctagaataatggcctccagtttcatccaaattgctgcagaagacattattttcttccttttcatggctgagtagtattccatggtttatatataccagatttactttatccactcattagttgatgggcacgtaggttggttcctaagtgaattgtgaattgtgctgctgtaaatatatctgtacaagtgtctttttcatatgtcttctttatccaaagaaacctttatacaaaggtttactttgtataaccattatatagttgtcccttgatatccttgggggactggttctaggaccctcctggatgccaaaattcatagattcccaagtgtcttaaataaaatggggtgatattttcatataacctatgcatgttatctcatatacttttaatcatctctgggttacttttaaaaatgtaaatgctatgtaaataggtgttatactgtattggtttttcatttgtattatttttgtattcttttttattgtttgtttgctttttcccaaatattttctatctatggtttgttgaatctgaggatgtggaacctgtggatatggagggctgacttatatagagggaacatcataaaacctttttctcccttagatcattacttcttgagcacctggcaaatgtaaagtactgttctagaagctgaaggatttccgtaaatgcagaatatgttaccctaccctcaaggattttacagtccagttggtgaatggaataggtcgtgcatagtacaagtcaataggcacaagcacatgaacaaatcagacagtaggggtcatggtatataagagaagggtgatccagaaataccaaaaagtatctatgcagagtgtgagtcaacactgtgtacataaaactaagtttttaggcccagttaattaacattgctgtttttactttttcattagcatgttggcagataaattgaacatgactccagaagaagctgaaaggtggattgtaaatttgattagaaatgcaagactggatgccaagattgattctaaattagtgagtattatgttagctatgctacatactatcagttcctgattatacttttgggaattcttaactaggacattttattacctcctttaataatttattttgttttaatgtaaaacagttctttgaaggcaacagaagcctcctattttttttcttccttggtaaatattgtcatctctatacagtgcattaaaatatgcgcaaaggtatgtcatgctttttacttacctgagaaactcagtcattaacattataggatcaatttccctgtgtttccttttagggtcatgtggttatgggtaacaatgcagtctcaccctatcagcaagtgattgaaaagaccaaaagcctttcctttagaagccagatgttggccatgaatattgagaagaaacttaatcagaatagcaggtcagaggtaagaaccacacatcttctattctgtctggggtttagcaaccatgtaattgttacatgaagtttcaaagtgtattgatgagttgtagctgattttgtttttctctttaaagatatgaacatttttaagaaattactaaacagaaaattttttcttagatgtattatatgcattaaacatagaaactgaaaaagaaattgtgttcctagtttattataactatttttcttttgctttgactcttcctgtgtgacttcattaactcatttcctcagggttttcaacacatcattttgatactggcagatgataacttacatgtgtagccctctttcaagtgttcgaaatgtgtattctttctaaatctaaagaaataattctgtaaaaatgttgatcttattatatgtattagtgctgatcttatacaaatttcattatctttcatctgatattcatatcaaaaattaatctcccattttgatagagatcctgcatgttagagattgaagaaacttgaatggccttataattttggaatcctaaactgtgttgtttagacattatgattatgtgtaactggagggtaggaagtcattaggaagcagttgtgggatatgcagagaccccatttgattgaaattttaggaacaaatttgtgtccgcagaataatcctttagttcaaatgagaaggatgcattagaattcaagttgcatattttagccaagtttagaataactgagcctagaaagtaactttcatatgatgtttttttctgtatgctttaggattaatttgtatcatttattgttccagtattaatgatactgttattgctatatattttaattggccaaaagctataccagataataattttggtgtttgttttgtcctgagtgggacatctgacatctagtaattgcaggagttaagatcttagaatggtttggcaagagactatagtgctgaagtaaatgctgtgttactttcttctatgttagtttttttccgaaagtattttcttttcacggtgttgatttctttttgcatattttaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 32 - DNA, 153 bp, Artificial sequence
  Exon 1 of the human EIF3E gene (ENSE00002112612)
tgttcgtttgtcggcgctaccaataaagttttagtgagcacagactcccttttctttggcaagatggcggagtacgacttgactactcgcatcgcgcactttttggatcggcatctagtctttccgcttcttgaatttctctctgtaaaggag

SEQ ID NO: 33 - DNA, 94534 bp, Artificial sequence
  Human RSPO2 gene (ENST00000522333.1)
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggtaggcaacccacaccaaggcagccgcagctgcggcgcttgggtacaccgccgtggactccaaatggcctaagagcgttcttttagccctgcgctctcagtgcctttagagttctttcctttccccggagcgccggcacaacgcattatgccgctgggtcggagcttagggctcggcagaggttgctaattcactgattataatcaccttcctctccaactcgtccgcagctgcccgctctggattaagccgctccgcggctcgtgctaggcagtgggttcgcttcctccttccctctcttctttaaattgggacgtgcgaaggcgcagctgcctccccggggctctctccatcccccacacaccctgttttcgcttcttgtctctcaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggtgggtccctctctgccaaaggtgcgtggtgggcttcaggggtggcgtgtggaggcgctcactcacgccctggctccgggggctcagatggtcagggctgtgctctccaccccagcttttgcgggtccccagtccccacctttaggaccctggagctctacaaaacactctgttttctgtaccctggaggcgcggggagccggagcgagacgcgctgggagctcggcgagccgggcgccaatcgggcgctcagggctaagtcgtgcggtccgcactcatgttcgccgccccacctcctcatctaaacttgtctctttaggacgtatttcttatctgacatgcattttttttttgtcgtcgttgttcttctctctgtcctcctaaccatcttccctgtagctcatttgttttatcttccccatccacgtgcgccccaaacccggcctcagatctcttcggacttgacctagcatagtgtgtgtgtggtgtgtgggtgtacccaagcgtgtgtctgtattccggagcttgggaggggtaccaagtcgagggggaggacctccctttccagaaaaaggccaacatagatctcttttttctggaaactgcgacgagatgggaactttctgaattaagcagcaattcccgcgctggttttctggggagtcctcgcctccagaggtttgtttttaaaacaggccccacttcgctctctccatttgctttgcaaaagcagccacaccggtggaggcttctgttctcaatgaaattcacttgcggctttttaactgctccctccctctccatcacttgtgcgtagcggagaaggcgggtggaagcctccagaaaggtttcggggaactcgctttcctgcagatttagtgcgtatttctgtctcggagtccgctggagatgcaactaatccaactgcattttagaagaagggcggctagacacgattcaattttctgggtggatttaaacataaaccactcaccacacgcacatcgaattacccgcgcaggaagggcgcgcagcagccccttcccagggacctggtgagagctgtctatttcattcggcactttggacttttgcgcaattagaatttgtcgccgggttcatgaatgttgactttttctccaagatgtaaacatctcactcgatctgtgatgtgatttgtttataactcattgtgtgtaatctccgctcctgcatccagattttgaggaggactttccgaaccttatttttttgatggctttttaggacattgttaagctgttctcacctaggggcagagctagagattggcccacctgagcgcagagctccaaataactgatggtgtgcgacttctgtagtccctgcgcttcaattgtctctgtatctgcggcttgtaagaataaaccttctccaacttctctccctccctctcccccgatttctgacttttggaaattgtttattttcagaaattattttacttaaaaatactagagagaaatttcttcccaaaggccatgagagtttgatattgatacttgtcttgaaaaagtccctttttatctcctctctcctcccctcctgattcctttctcaatcccagtactttctttcgagtattcggcagagccagcaatttttgattacattatggtcaaaagtgtttggagaggcttttcctctttttataagtcaaagctgcagtctacttagaaaaactaaagtgcttgaagtctgcaaaatatagaaatgtctaaaatcctttgccagatccttattagatgacttgctaattcagtgatggctttctgatccaccctgcctgtcccattgtggttgagtggggaagaaccaagcatattgttttagtagaacttaatgcagagatgctgtttggtggaaaaggacattacagcactcctgcggccagaagggatactgcatgccttctctgcagtgccatctctaagaatctgcctatgccttcttaggtatctgaagcagaacctatttatttcaaagcttacttttagcaaaatctcttgtaacgattaccatccacatcccaaagcactgacagtctaactctaaattgtgcaatagtaacttatgccaaatcaacctttcgatttaataaaattcaaatgctttcaagaacgtgtaaattggtaagggtgtaaaaaaaaaatcaaactttttttcttcttctcaacagatatccctttacaaatcccaagtttctggctaaaataactgtcgtccttaaaagtgaccacactatctgtaccaacaaagggtgtactgtgtttttaattaaaagtggaactacttaaagggctggccagacagtgtagggtgatagtagcttttctactttgcagggaagcttaaggattgcattgtgagagtattgaaatgaatagagatctaactcaagttgtgtgaattgtccctcttcacaaacttaagctggttttaattgatctcatgtccactgattgatcctacaccaattgttgtgcataccaaacaattggctttccccaaaaagattgatttcaattagttcctcagtgaatgcttgactactggccaaatcatgtcagcagtgacagttgacatgttagggcctatgtgataccaacatttccctttttcccctttgttttggatagtgtcagttaaatattattttccaagaagaaaagtaattggtattttttataaaaggtgttgtagtttggaagattagttattttcttggctttgtgctacaagtaggtggcagtggtaccaggattggttaggcttacccctgggacctgattcttttttttttttttccatattccatctgcgaataatcaaaccttcactgtggagcattctccgaactcctttggcattatgtttagtctgctctatgatctcacatgctccataatatcattttcttaatgaaataaaattcttggcagagattagataatttagtcagttaaaatcaattgcatccagtttggaatggagagcaaatatatcatttaacggtatattttatttcaaaatatagccagacgattgagaaaatagtattttgaccgtctctacttttggacaaaacttcaaatgggggagatcatcacgaacaataagactacctacctaccatattttcttccccttattttgaaaaattataaaaatgcatttgatagtcactaatggggcctggttgcaataattttaaaaaattaattaggcacaaacacaatacaatactgacaatgaatatcttttagaggggagacacatgccaacattttgaaaagctgattaataactcttatttttctctccatgtagcatattaagatttgtctccctgactcccccttcaaaatagtcatgattggctattgttaacccctactatctgtcttggtcttgaaaccacttatgattgatttatatgttaagtggagttctttgattactttcattttttggaatggttgtaagccacatttcagactggattactgaaaggtggatagacaaatcataactttattgtggtctcctggaatttctggagcatggcatgtaatgacttaatcttatatctccctcattctatttttataccttgtggtattttaaccagggatttatgaaaacttcttgatataattctcaatgcagcaaggtttccaaatgtataattcatgtttctggtggtccgatggcagggggcgtgctatgactagtgtttctttccgtagccttttccgtactgaatcctcagcttctccttcctctaataactccttgtttcacaaaattagatatagtttcttccataaaaaggaagggtttgtcacaaatattgtggcatgtttctggtaactgaggccagagaaagcaaacattttctcttaaaccttatagagataaattaatttgtgtttgtgttcttaaaaatttaatgaaaagattcgaattttttttttacaaatactttctaaatagtttacttctcctgatattctttcaaaatacaaaatgacacatggaacatactaacctacagttaaatgaaaaagtttcaaaacacattttgtacacttgcttactttaagttccaaagtatttcagaaaagctgatgtgatgtttaactttgcaacataaacatgttctgttcttttctcttttttgattggctgctttctcttccaacataacggcataattttttaaggcagggtcttaccagtacagagaggtcagaaagttgctgtgctcaaactaacatcttattttgccacagaaatttggaagtgattcagaataggtgacattcccctaggccctgggctttctttatttgcttttaaaatccagcttggctagaatccaatattcacagaaatcacaagttggaaatgacacttctagttccctaatgcaaaaccacctcttatttagagacaaactggccagtttgtggaatatccagggtacttctttccttccaactgactgcctttaaactatttcttttggaaatacgtatccttatccatcccaagtccaggaagtaggggacagacagattttatttgatataagcttgataactactctgctaaaaggaggtgataaactctgggatgacaaagttttaaaatttctgtatttaagatgacatgaagcttattttttctccattaactgcagcaatcaagggctgatcaggtgaagacagtgttgcgtatctatatttatacattttcatatgttcatccagaataaatagaaaacatgctaattaatactaaagtgtatacataatgtatatttatatatattagggaaggtatatatgcatacgtgtatacatgggtgtgtgtgtagggaaagcgatgagtatagtataattatggaggatcgggatttcagaactaaaagattttcactcatttttttctagtccttttcatctttctcttcgacaagatgaaaagatgggagtgggtgggaaagggggtggcagggagagaatgagaataagattgggtagggatagtgtttttactctttccaaagcccaccttccacctgttcttctctcctctaggacccttctggatcagtcacccttatttcaagcatgctgctgttcctctaatcccaaaattgctgattccctccttcttcacactgctttccaatctcttctgctttccttcacttcttcccttccctcctctggcttgataatcctgtttcattcactcttcaatctgttactatttggcttctaccttcacccttttaataaaaagattttcttttctttaaagaaattaacaaacaagaaaaatattaaaagtttataaatgttagacttattttttagagcgcttttaggttcacagcgaaattgagtggaaggtacagagatttttagaaaggggtttcttaatggccagtcatactcccctcattgccaagtccagcatcggtacagttctctgggacttgttcctatggtgatatcttatcacctctttcctttggctagtgacactgcactggttttacctcctattttctgtccattctcttctttggttccctcactgagaatgtagactagtgtttcttcacctttattcatttccttggggaattttacccgtccctgtttctcgaactgtcatttctacataaagtcctttaattctaggctcaatttttcttttcttctttttttttctttcagcttcagattatcctacactcagatctcccaattactgccaatatggatagatattccatgcatactcaaacctgacaattcgctttcttttctgtgccccctcccaaatgtgttcctctgcttatattctttttttatccatggagttctgggtgccaaggctgggagcctcgctatagtctttgacttttctgttgcctcgtatcagtttgttcttgcctaaactatatcggattagtgagtttatatccatctcattctttccattcccaaagatatttcctagctcaggctctcatagactcctcatcctccagcatctacttcaatccacttatgatgctccatcccttacagtgctgccacattccatttttctccaccacagatctgatcatattacttctctgctaataaaccctaaacctcccaggcctccatattgactgccgaataaacaccagccttttctatagcagtcagcgttccccaccatctgaccacagcctgctttcaaccttctaccaccttgaaagcacacttggcttaagctatcccagataacttcatttctgggcatgccatgtgttttcaagctcttgcgctgttgagcatgtgtgtggtgcccacctaaaatgccactgcttctgtgaagccttcctggaattttctgccttcctttctaaagccaaaatcaattattccctcatagtttcttagatttctgggctattcttaaaggactcttatttttcctttttttctggttatcttgccttatgtatcatcatattttaagcttctcttaggcagaactacggtacatttatctttgtactcctcaaactagaccttttagagtgctttctccacaaaatgtagtggaacaaaaagtcattgtatataacatttttgttgttttcccttaaaattattttggtgacttaatgagaaatgctgtttttttaaaaattgaagttctttgcacatagttgatgtttgaatgattaaatattatgggtattctcattatttataattctttatagtttaaagaaaaattaaaaaaaaaaacaggtataaaagcattcccagcccagtactcattctgaagtctcttctgattatttcagaatttctccgagtacactagtgtctgtgtatctgtatacttgtttgttatttgaatgattgagtattccaagtgacaggtgatttgtgggtatggtagggaaaactggtggtagtggggtaacccttttttttttttttgagatggaatttcgctcttgttgcccagcctggagtgcaatggtgtgatcttgactcactgaacctccacctcctgggtccaagtgattcttctgcctcagcttcccaagtagctgggattatagatgcccaataccatgcccagctaatttttgtatttttagtagagatggggttttgccatgttggccaggctggtcttgaactcctgacctcaggtgatcctcccgccttggcctcccaaaatgctgggattacaggcgtgagccaccgtgcccggctggtaacccatattttaaaaaatacttattttatagaaaagggcaataaaggatttttatccccaaacactttgaccatatgaatgaataataatttaggataaaataaaagaaagtggtatttgccttctatatactcatattaataatataagtacaggaaaaaatttaatcctagttattatatttatgattttagtataataaatgtagctatgtggacatacccatgagagatacagatgtgtgtgtattttagaacaagttctgtaagtatgaagagaccacacagttctgtgtagtgccttccaggagaacactgacatttcactgtcctttgaatgaagtgggacctgtttgacgtatacagaaggtgagctgcttatagaaacgtgtggttttaaaactaacagttaagaggaagagaacagagctaggatccaactttcctgaattcactaggttttcctgtacacggtatgtttcaacataaacattaattcaaagaaaagaaattccctttgaccccattcaaaattcttcagaccacagacccttattgatccccagaacttcctacaactcataattatgctaataaagtaatgaatattaaataactgaaggctgaggggtggagtaattgaggggcaggaccataagtatgttttagtaaaaatttgcatacttgcattggtaatttttaaaattatttttgaatatgaattatagaaacatttctagtatagccagaacaaatgtgtgtgtgcatgtgtgtacttgcctgtacatgtgttcatgtatgtgtgtatgggtgtctatgtgtattttgtgtttaacacatgttagaataataagggtcagagcaaaggtattaaatatctcttattttttactctaaaatgtagagaaagtgattataggtagcttttctcatctagtcatttggagaaaaccttttacaatttacttaaaactttttcaattttcatctcttgctgaaagatactaagagcacttataaaatagaagttacccagtttagcacatttgttttcagaagggtttcttaacttggggtccagaggtagggctagggtttttgtaagcttcctgaaattagaagcaaaaacattttctgttgctttttgtggtgtagagggacgatatagagctttcactaaagtctcaaagaggtccaagtttcatctctttccttcaataggttaaggagcattggcttaaaaaataggaggtggaccttccaaattagcatgatgccaaatgactgcttcaaagtgatacacataattgttttctaaaagtttattttccttgtgtgagttttcagccatttgctatgtttatatttaacaatatgaagccacactggaagcactgtctcaagatttatttcagtaaataattacttggcaagtaattccttactcaaagacaatagttgttaaattctctcaatcccactaaagagtttataaaagtacaacacaaatatacagtataggggttttgttaaaacttctcatgtgatctaacttttatctcattaagaaaacagttaatatatagttttagaaatagctgttgtagctttccagctggtgacatgtggtgctggcattgatctgacttgaggcatcatgctgccagttcacagaatggccagaactggggcttagcactcttcaattctggccaagtgggctcctgctagatctttgtttctgtgtcagcacattttagaatttttgtaacatgaaggccttagtccctcccctgttgctggatacaattgccaactaatcacctcagcaatgaaaacacatggaccaatagagggcacactttgcattcttttccctgtgctttgttctctgaaattttgtgggatttgtgcttcctttgctttgccctattggttcaggggcgaaacctgctctgctccccccatggacactgtggtcatcttgatgtcatcacagagagaacaaaggaacaaataaaaagaactttcagtcttactgagcatttcttgttttgatcgctaatctccttttgacaagacctcaccaagaggcaaactgaaccaacctcactgttttagtatctgtgagacacagatgtgaaagctacagatttaattaacatgcaggtagattccagcttctacagccactttgaaaaacatcagtgggttttattttattttttaaattcagatgttttacataagatgaatgccctaaaatgtaagcaactggtgaaatttggagttgcccaaatgactgcaaattaatacttcccaattaattgtttttcgaattctttaatctttatagagggacctatttatttcgatgcttctctcatactttggccctttgagaattgtaaaaattgtctaatattttgaaaatccaaagttgttgttgttatttttttgagactgagtctcgctctgtcccagccaaagtatttttaagttcttattcccccttgtgtaataaagtatgacttggggctgaaaaattctctggcatcggccgggcgcggtggcttatgcctgtaatcccagcactttgggaggccgaggcgggcggatcacgaggtcaggagatcgagactatcctggctaacatggtgaaaccccgtctctactaaaaatacaaaaaaaaaaaaaaaaaaattagccgggcttggtggcgggtgcctgtagttccagctactcaggaggctgaggcaggagaatggcgtgaacccgggaggcggagtttgcagtgggccgagatcgcaccactgcactccagcctgggtgacagagcgagactctgtctcaaaaaaaaaaaaaaaaaaaaaaaagttctctgccatctcattgtttttcacctcacatgctatgttctcatgcctcttcctggtagtcaaaagcaggcttttaatgttgaatgatctgcgctgtgtcatcattaaacttcatgtttagttattcactctttttctcctccaagattttgaagacttactttaccctgttgattcagctggcagacctcctctgcaatccccatgaagtttaaccgaatcataggagattaatatcctatgaccaaatgacatatcatctgctcacccccaaaaatataactctttgggggtaactatggtatctgtcattccctgctcttttactgtcatagatggtctttaaaaactctgccctggatgagacaccttgctggtctagtgtattgggaagagttgttcctgcagctcccatgttaccatacctaaacagacattaaaagaagggaatcctggtctttgacttgtcatgtcttctgggtagttctagtaggtggaagaacgtctacaagaacttatgtttattttgatacttgcttcttgatgacgttctagaggttcactttcttcagatgtgtgtgtgtttaagggaattttgagaaactcttgcttgttagttctgggctcttctaaggagatatgaggaagtgggggagaatagctgtaggttgggtaactggaatgaagaaactagcttaatattttttacttatccaaggacttcagaaaaatcagagctgtcctatccatagcattccttccactgatgaaagatatcttgtggccgccctccttcacccagcatagtgcaattgagaaactttgttagggtcaagaaactacgtaatttgaaaaaccactggtgtctgataaatgtacagcagtcgttcccagaagcactattagtgggttgaggttagtttgttgtggtgatagagaagccatttgcaccactcctggtggtcagtaagttacatcagcagtggctgatatgattcttgactgaatcctgtcaattatgaaagttcttttttcccctcatttaaataatattaccctgaaaattgatctagagctttggaaactaccccttgaaaactgattccccaaatcataagtttagtgtaatttaattgttctctatgcagaggggaattagttctttgcagctactatgggtgatctcaacatgatttttatttgaaagtgactcagatgaataactgttcaggaggcttggcaagcttctgcatatcaagcagtcgttttttgttgttgttgaattcagagagaaaagtttaagaaatgtgacaggctggacctagggaaaggaaagagcaggaacaagaccatttcctcaaacttgaggtcgatcatgtgaaaaacgaatgtgatttatttttgaaattaaagaaaaaagtattttatgaagaggaagattaaagtttatatttagaaaattatccactaatggaagagacccttctttggaattttgactttggaagctgcctctttccaacagcagagagcatctcgtgagagtgttttaaagctggtgacttgacaacactctcaagagtgaactctaaggacctttcacactgtaagagccaccccacagccatctgtaatgcatgtggtatctaataggtagttaaatataaagtcttgttgacagctgcttgaactcaaaatacaagactcttgccttcctgaagagaggacactaaacaaaactactttaagagatggggtcttctttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcaccactgcagtccgcagtccggcctgggcgacagagcgagactctgtctcaaaaaaaaaaaaaaaaaaaaaaaaagagatggggtcttgctgtgttgcccaggctgggctcaagcgatcctcccaccttagcttcctgagtagctgagatgacaggcatgtgccacgactctcagctaaaattgcttcttgagattccgcaccatatgcttctgcatcattgttgtaaacttcagtaatatgctagatattgacattcaatatgaatttctaaaagaaggtgtatacctcaattcttacatgaccatgatgctaatttgtaggatgtttcattataagaaactttgagatttcaatatgactataatcagcatgggttataccatacagatattttgctttctttaatgggttgctagactggaagacaagtattagacaaaattttattaatactatctggcacacctatgagggcataataggcttaaaaacccgttcagacaaggtagagaaatgcaagtatatcatcttaagttactttcgtgagttacatttggtagagagtggtgagtaatggattgatgtctactctgtgggaatcctgggtatacagaaggaacctgtcttcagccttgtctgaaacaatattttcttaatgatttcattgaagacaggtggtaggctaaccacacttttgcataatatgaagttgaacaggacatttaggatgtgggatgactggttacaaaaagatctcaatggctaggaatgacaggatgaatttacaaatgaaatcttaatcagaaacatgtagagtttactctttaaaatgaaagaacttgccgggcgtagtggctcacacctgtaatcccagcactgtgggaggccgaggcgggcagatcacaaagtcaagagattgcgaccatcctggccaacatggtgaaaccctgtctctgctaaaaatacaaaaattagctgggtggggtggtgcatgcctgtagtcctagctactcgggaggctgaggcaggagaatcacttgaacccgggaggcggaggatgaagcaagctgagattgtgccactgcactccagcctgggcaacagagcgagactctgtgagtgtgtgtgtgtgtgtgtgtgtgtgtgtgtgttcacacatacatgcaccaacaatggaagaataggatgtcggacacaaggttttctcattgatttttgacttactctgaggttataatgtaatgtaattgcaaaaagaattggttgcattaagagaaatatttacctagattcaagaataaaccagatgaaggctcttagcctatcttatattcttttctagagtcattactttaagaaatgcattggcagcacacattattatacagtattaatttcctaggactgctgtgacaaagtactacaaactggatggtgtgaaacagcagaaatatcttttctcaccatctggaggctaaaagtccaaaatcaagatgcaaggaggttcatgctctctctgagactctaggggaggagacttccttgtttcttccagcctctggtagcctcaggtgttccttgacttgtaacagtagaattccaatctctgcttctatgttcacatggctgtcttacctctgggtttatttcttttgtcagaaaaccagttctattagattagggctcaccttaataacctaatgttaacttgattacatctgcaaaaaccctatttgcaaataaggccacattcacaggcactgagaattaggacttcaacatatcttctttgagtacacaatgcaacccataacaaataccctttgcatcatacccggtagtcttttaaatccttattttcataacaaccctgtggaatattgttaattataccataatattattagtataacaagtagtggttatagaagtggaatacttagtagaggtaggatcactgcatatagctacagagtgtatattggacataaagcaagaatattaatggcaccccctggacttgtgcataccatggccctgagggtgggaatgctttagacatggtttataagtgtacggtgtttggagtatgtaacctcaagttcctttcttcctctaaagttgtgtgaaactacacaaactcagagtcacctctttattacttattacaacatctttattactttttcaaacaaatctgtacatcaacttggcttcttgctgttcatctctatcagctgaagctgaacattcagtttagctgttttttttttgtttgtttttgagacggagtctcactctgtcacccaggctgcagtgcaatggcgtggtctcagctcactgcaacctctgcctcccaggttcaagtgattctcccgcctcagcctcctgagtagctgggactacaggtatgtgccaccacacctggctaatttttgtatttttagtagagacagggctggtctcaaactcctgacctttgtgatctgcctgcctcggcctcccaaaatgctgggattacaggtgtgagccaccgtgcctggccttagctgtttttattgaagaagttagctgtcctctaagagctgctagtgctctttatggagcattagtgaaatctcaatattgcctactatacatggcttctggtggtagagtgtcttaaactagtcttctctgattttgaatagtgtcaaatgctggcactgccaaggggcttgatctattcatgcttgtgtgttgcatataaagggctagtaagaacattcttttaaagctattgtgaaatttttgaaacataaaaaagtaatgtgatgaatccctacatatgcctcacccaggctgaacaaatattgacattttgccacactgactttatttattctttattttctgttttactttgtattggctgaaatgttgtaaagaaaatcgcagatattacatcatttcaccctacatatttctgagtgtatttcttacaaatagagattttctttccaaaattcaatgtcattaatctacctgacaaaattcgttatttcttgatagcacctcttaataatcggtatgtaatggatttccccaattgcctcaaaaatgtctttatacagtggctatgcttgaatcagcattgaaataacacccactcattgcacttggtgggtatgtacctaaagtttctttgattctagggtattacttccttcccactcagttttcaatgccattgacttattgaaaaagaaaagtcaattttctgcagaatatctcacatctttccatgtgttctcctcttggggttgtttaacttgttcctcaatcttccacaatttctgtgaactagaagttctccttgaaggttggattagattcaggttcaacttttttggctggaacactgtgtaggtgatactgagtgcttcatattacatcacaccaggaggcacacaatgtctcgttgtgccattcttagtcatgctgagattaaccagtgggttcatgtggtaccagcccaatcaccctccattttaatatttgtctgaattaacagtttcattaggggttgcaaaatagtgatttttttttctaattcttaccacatttattagctgaaaattttctattaaaaactgttcctttttcagctatagatatttttgtactatgaaacacaattcttccaggtaaagcagatgataagcttattttcttccattttaattgcaggttcttagaaaagagagttgatacgtgtttagctgggacagtgggtgagcttcatgtaagtgaataaagtgctttgatttgtgtcaagccattccttgtcagatggaggagaagtcttccaacagtttctgcttactgcaacagcagtagtaaaatgacattaaaaaaaaaagacttgttggtttttgctaacaggaatgaaatgcaaaccttctggaaacctgaattcaattagacatcttctgataatgttttctgttaatagctttcagagaagctactgagttgaacatacagtagcttcagtatggtgtaatctgaggctcattggatggaaaaacagtactttctgctactttaaacactctctggaaggcttagagaggagaggaaggaaaatatttgaggagatcaactggatgttgtagaatacaagtaatgtcacctgagaaggattaagttttctcaaagcttgtcttgaatggcagctagccacttagatttggcccttgtaacccatcaggcttgtctgtttctgtgcactcttgtcttttctttttctttttctttttttcttttttttgagatggagttttgctctttgtagcccaggctgaagtgcaatggcacgatctctgctcactgtaacctctgcctcctgggttcaagtgattctcctgcctcagcctcccaagaagctgggattacaggcacccaccaccatgcccagctaatttttgtatttttagtagagatggggtttcaccatgttggccaggctggtctggaactactgatctcaggtgatccgcccaccttggcctcccaaagtgctgggattacagacgtgagctaccacgcccagcctgctgtgcagtctttaacttaacatataaagaaggggcctagagattacatgtcttctgtgggcaggggacagtaaagttttttttttttttttttattccttctgcttattaggtgcagctggctctttctaattacagaaacctttcctttattcatttaaaaacttagctcattgctttgaatcattactattggcatagtttttgtatgacctgttgaaagatacccataatatgtacatttaacagttttactatccagtgaagtcaaaaatttaattcacacgaatgcctattgagaggattaaagggctcattatacattttggccataagtattatgaatatacaatatttaatacgtggctcgtaaaactcttgctggagtaagacaacactggaggtgtgtgcttttcttactagtaaagtgccttcgtagtactcttctttttttttttttttttcaatttctgagatacatgtgcagaatgtacaggtttgttacataggtatacatgtgccacgtggtttgctgcacctattaacacgtcatctaggtgttgtagtactcttttttttttaacttatactttaaattctagggtacatgtgcacaatgcgcaggttcgttacatatgtatacataggccatgttggtgtgctgcacccattaactcatcatttacattaggtatatatcctaatgctatccctcccccttctccccaccccacaacaggccccggtgtgtgatgttccccatcctgtgtccaagtgttctaattgttcagttcccaactatgagtgagaacatggggtgttcggctttgtccctgtgatagtttgttgagaatgatggtttccagcttcatccatgtccctacaaaggacatgtactcatccttgtttatggctgcatagtattccatggtgtatatgtgccacattttcttaatccagtctatcattgttggacatttgggttggttccaagtatttgctattgtgaatagtgccccaataaacatacgtgtgcatgtgtctttatagcagcatgatttataatcctttgggtatatacccagtaatgagatggctgggtcaaatggtatttctagttctagatccttgaggaatcaccacactgacttccacaatggttgaactagtttacagtcccaccaacagtgtataagtgttcctatttctccacatcctctccagcacctgttgtttcctgactttttaatgattgccattctaaatggtgtgagatggtatctcattgtggttttgatttgcatttctctgatggccagtgatgatgaccattttttcatgtgcctgttggctacaaaaatgtcttcttttgagaagtatctgttcatatcctttgcccacttttggatggggttgtttttttcttgtaaatttgttttttttgtagattctggatattagccctttgtcagaggagtagattgcaaaaattttctcccattctgtaggttgcctgtttcactctgatggtagtttcttttgctgtgcagaagctctttagtttaattagatccgatttgtcaattttggcttttgttgccattggttttggtgttttagacatgaagtccttgcccatgcctatgtcctgaatggtattgcctaggttttcttctagggtttttatggttttaggtctaacgtttaagtctttaatccatcttgaattaatttttgtataaggggtaaggaagggatccagcttcagctttctacatatggctagccagttttcccagcaccatttattaaatagggaatcctttccccattgcttgtttttctcaggtttatcaaagatcagatggttgcagatgtgtggcattatttctgagggctctgttctgttccattggtctatatctctgttttgataccagtaccatgctgttttggttactgtagccttgtagtatagtttgaagtcaggtagcgtgatgcctccagctttgttcttttggcttaggattgacttggcaatgcgggctctttttggttccatatgaactttaaagtagtttttccaattctgtgaagaaagtcattggtagcttgatgggatggcattgaatctataaattaccttgggcagtatggccattttcatgatattgattcttcctgtccatgagcatggaatattcttccatttgtttgtgtcctcttttatttcattgagcagtggtttgtagttctccttgaagaggtccttcatgtcccttgtaagttggattcctaggcattttattctctttgaagcaattgtgaatgggagttcactcatgatttggctctctttttgtctgttattggtgtataagaatgcttgtgatttttgccggttgattttatatcctgagactttgctgaagttgcctatcagcttcaggagattttgggctgagaagatggcgttttctagatatacaatcatgtcatcttcaaacggggacaattgacttcctcttttcctagttgaatgccctttatttccttctcctgcctgattgccctggccagaacttccaacactattttgaataggagtggtgagagagggcatccctgtcttgtgccagttttcaaagggaatgcttccagtttttgcccattcagtatgatattggctgtgggtttgtcataaatagctcttattattttgagatacttcctatcaatacctaatttattgagagtttttagcatgaagggcagttgaattttgtcaaagtccttttctgcatctattgagataatgatgtggtttttgtctttgggtctgtttatatgctggattacatttattgatttgcgtatgttgaaccagctttgcattccagggatgaagcccacttgatcatggtggataagctttttgatgtgctgctggattcagtttgccagtattttattgaggatttttgcatcaatgttcattagggatattggtctaaaattctttttccattgtgtctctgccagactttgatatcaggatgattctggcctcataaaatgagttagggaggattccgtctttttctgttgattggaatagtttcagaaggaatggtaccaactcctccttgtacctctggtagaattcggctgtgaatccaactggtcctggactttttttggttggtaggctattattgcctcaatttcagagcctgttattggtctattcagggatttaacttcttcctggtttagtcttgggagggtgtatgtgtccaggagtttatccatttcttctagatttcctagtttatttgtgtagaggtgtttatagtattctctgatggtagtctgtatttctgtgggatcggtggtgatatcccctttgtcatattttattgcatctatttgattcttctctcttttcttctttgttagtcttgctagcaggctatcaattttgttgatcttttcaaaaaaccagttcctggattcattgatttttttgaagggttttttatgtctctatctccttcagttctgctctgatcttagttatttcttgccttctgctagcttttgaatgtgtttgcttctgcttctctagttcttttaattgtgatgttagggtgtcaattttagatctttcctgctttctcttgtgggcatttagtgctataagtttccctctacacactgctttaaatgtgtcccagagattctggtatgttgtgtctttgttctcattggtttcaaagaacatctttatttctgccttcatttcgttatgtacccagtagtcattcaggagcaggttgttgagtttccatgtagttgagcggttttgagtgagtttcttaatcctgagttgtagtttgattgcactgtggtctgagagacagtttgttataatttctgttcttttacatttgctgaggagtgctttacctgcaactatgtggtcaattttggaatatgtgtgatatggtgctgagaagaatgtatattctgttgatttggggtggcgagttctgtagatgtctgttaggtccgcttggtgcagagctgagttcaattcctggatatccttgttaactttctgtctcgttgatctgtctaatgttgacagtggggtgttaaagtctcccattattattgtgtgggagtctaagtctctttgtaggtctctaaggatttgctttatgaatctgggtgctcccgtattgggtgcatatatatttaggatagttagctcttcttgttgaattgatccctttaccatgatgtaatggccttctttgtctcttttgatctttgttggtttaaagtctgttttatcagagactaggattgcaaccccttcctttttttgttttccatttgcttggtagatcttcctccatccctttattttgagcccatgtgtgtctctgcacatgagatgggtctcctgaatacaggacactgatgggtcttgactctttatccagtttgccagtctgtgtcttttaattggagcatatagcccatttacatttaaggttaatattgttatgtgtgaatttgatcctgtcattatgatgttagctggttattttgcttgttagttgatgcagtttcttcctagcctcaatggtctttacaatttggcatccttttgcagtggctggtactggttattcctttccatgtttagtgcttccttcaggagctcttttagggcaggcctggtggtgacagaatctctcagcatttgcttgtctgtaaaggattttatttctccttcacttatgaagcttagtttggctggatatgaaattctgggttgaaaattcttttctttaagaatgttgaatattggcccccactgtcttctggcttgtagaggttcttttgagagatctgctgttagtctgatgggcttccctttgagggtaacccgacctttctctctggctgcccttaacattttttccttcatttcaactttggtgaatctgacaattacgtgtcttggagttgctctcctcgaggggtatctttgtggcgttctctgtatttcctgaatttgaatgttggcctgccttgctagattggggaagttctcctggataatatcctgcagagtgttttccaacttggttccattctccccatcactttcaggtacaccaatcggacgtagatttggtcttttcacatagtcccatatttcttggaggctttgtttgtttcttttcactctttttttctctaaacttctcttctcgcttcatttcattcatttcatcttcaatcactgataccctttttccagttgatcgaattggctactgaagcttttgcattcatcatgtagttctcctgacatgtttttcagctccatcaggtcatttaaggacttctctatgttgattattctagttttccattcgtctaatcttttttcaaggtttttagcttctttgtgatgggttcgaacttcctcctttagcttggagaagtttgatcgtctgaagccttcttctctcaactagtcaaagtcattctccatccagctttgttccattgctggcgaggagctgtgttcctcagttggaaatgcagaaatcacccatcttctgctccgaccatgctgggagctgtagactggagctgttcctatttggccatcttggaaccaccccctggtattgtagtactctttttttttaattttattttattagtattatactttaagttttagggtacatgtgcacaatgtgcaggtttgttacatatgtatacatgtgccatgctggtgtgctgcacccattaacttgtcatttagcattaggtatatctcctaaagctatccctcccccctccccccaccccacaacagtccccagagtgtgatgttccccttcctgtgtccatgtgttctcattgttcaattcccacctatgaatgagaatgtgtggtgtttggttttttgttcttgtgatagtttactgagaatgatgatttccagtttcatccatgtccctacaaaggacatgaactcatctttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcgtgatttatagtcctttgcgtatatacccagtaatgggatggctgggtcaaatggtatttctagttctagatccctgaggaatcgccacactgacttccacaatggttgaactagtttacagtcccaccaacagtgtaaaattgtccctatttctccacatcctctccagcacctgttgtttcctgactttttaatgattgccattctaaatggtatgagatggtatctcattgtggttttgatttgcatttctctgatggccagtgatggtgagcatttttttcatgtttttttttggctgcataaatgtcttcttttgagaagtgtctgttcatgtccttcgcccactttttgatggggttgtttatttttttcttgtaaatttgtttgagttcattgtagattctggatattagccctttgtcagatgagtaggttgcaaaaattttctcccattttgtaggttgcctgtttcactctgatggtaatttcttttgctgtgcagaagctcttgagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtacttaatccatcttgaattaatttttatataaggtgtaacgaagggatccggtttcagctttctacatatagctagccagttttcccagcaccatttattaaatagggaatcctttccccattgcttgtttttctcaggtttgtgaaagatcagatagttgtaaatatgtggcattatttctgagggctctgttctgttccattgatctatatctctgttttggtaccagtaccatgctgttttggttactgtagccttgtagtatggtttgaagtcaggtagtgtgatgcctccagctttgttcttttggcttaggattgacttggcgatgcaggctcttttttggttccatatgaactttaaagtagttttttccaattctgtgaagaaagtcattggtagcttgatgggatagcattgaatctataaattaccttgggcagtatggccattttcatgatattgattcttcctacccatgagtatggaatgttcttccatttgtttgtatcctcttttatttcattgagcagtggtttgtagttctccttgaagaggtccttcatgtcccttgtaaattggattcctaggtattttattttctttgaagcaattgtgaatgggagttcactcatgatttggctctgtttgtctgttattggtgtataagaatgcttgtgatttttgctaaaagctctcaatatattaggtattgatgggatgtatctcaataagagctatctatgacacacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggttttcaattaggaaaagaggaagtcaaattgtccctgtttgcagatgacatgattgtatatctagaaaaccccattgtctcagtccaaaatctccttaagctgataagcaacttcagcaaaactcaggatacaaaatcaatgtagtactcttaaaagaacaaacagtattgcaaactgaagaaactggttatattgcaagtcagggaatagaactaggaatacacatagcttttacaaatgaaaagattcttgggattttttttctcttctacctgtttagtgtttttaagtaagaaaataaatgatctgtatccactatttggggtcagccattgatgtcatttatatgcctcctgctttttaaaatttgaattttgaatgttattttggtaataaccccctgcatagttgagacatttaggtgtttgtcttggaagcaggtagtaaagactttacactgtccttgtataaatagttgattttttttatagccacttactgtagttctttaaaaatgaatataagcccaaaatctattcattgttggcaatttgaaaaatagagaacaacactatgaagaaaatacaactaccaataacctttctactcagtggctgctgttaacattttgcattttatccttccagatgtttttcccttctacataaatataaagttttgaaagtgcctgtgtcataagtatatattcttactgattttgatgacatttagaatgtctgcatcataattgttcaacatcaaattttaaaatcagtttccttattgttgggcagttaaccatttcagtattaaaaagttttcaagattattaatatgctatcaataaccttatattttatacgtctttttttttttttttttttttttttttttttttttttgagacagagtctcactctgttgccaggctggagtgcagtggtgtgatctcgactcactgaaacctccacctcccaggttcaagagattctcctgcctcagcctcctgagtagctgggattacgggcatgtgccaccatgcccggctaatttttgtattttttggtagagatggggtttcaccatgttggccaggttggtctcaaactcctgacctcaagtgatccaccccccttggcctcccaaagtgctaggattacaggcttgagccaccatgcctggcccacatcttttttatcttaggaatcatttatggaactagaaataccagttaatacactataatcacttattgagcatttactatgtgccaggcatagtgttggttttcttttttctttttcttttcttttcttttttttttttttttttttgagacgggtctggctctgtgtcacccaggctggagtgcagtggtgccatcttggttcactgcagccttgacctcttgggctcaagtgatcctctcacctcagcctcccaagtagccgggaccacagatgtgtaccaccaggcctgcctatttttttttgtatatttttatagagatggggttttgccatgttgcccaggctggtgtcaaactcctgagctcaagcgatctgcctgctttggcctcccaaagtgctgggattacaggtgtgagtcactatgcttacaagattgggcccaagcgtaggttttgttgttgttgttgttgcctttttaaagaacacacatacttattagcttacagcatctgtggagcataagactccgggcatagcctaaggtaacttctctgctgcaggatctcatttgattataaatgtccaataatacaaatttcatgtttcagtggtgagactgtagtcaagaaaaaaccaattcccctataatacataatctctgcaggcaagcatagtttttaaggttacatattatttaatcctcaaatgaccttgtgaggtagacctatttttctctccatcttaaagatgaatctgagggaccagagggtgaatggtttgtctaagttcagagctaataagtgatggaactagaattctatctaggcattctgacccagccatgctcttaaccacgagatggaaatgtgaagctgtcaatctcactgccagttgttctccaggatattgtactaattataattctgtaggtgggagatgttgggcatattgccttgagccattgataattttttttttaacgtcttgttggcctgttcctgttgtggataaaaataaacatctcccttatccccaagaaatttagtatttaaatagggaaacaatgcattctttcccacatttcctggctccaaataacattaatatctacttagttgcttaaatagtccttgttttctcctcaacacccattatttttacaccctcttttcagtatgttttgaactccttttcttctaagtcggctgccattttgtaggccaggatgtcaccatcttccgaacctgtccatggccttcccactgatctttctgtgatccattctccttaggacagccaagaattgcttataaaatgaaaatcagcaattctcccccccatttaaatgcttcagtggatttctattacacctcaaataaaacaaactcctcgcctagcctggaagcctctctgtgacctgtctgcctctgcctcctccaactctcctttcattatctcagtcctattgggcttctttctgtctctcatacactcttgacttcctcctgtctcattacctttgcatttgctgttcactctgtctagaaagctctttactcgtgtttttcacaactagcttgatcctttcacagtaactgtatctaaagcagcacatttttattttctgttttcttttctttttcttttgatacaaggtcttgctctgtcacccaggctggagtgcagtggtgcgatctcagctcactgtagcctcgacctcctgggctcaagcgatcctcccacctcagccccctgagtagctgggactacaggcacgcaccaccacacccggctaatcgttgttttgttttgttttgttagagacagggttttgctttgttgcccaggcttgtcttgaactcctgagctcaagcgatctgcccaccccaggcttccaaagtgctgggattagaggcatgagccaccctgcccagcccttttccgttttctgtagtaaactatgaggaccaggactagggtgcggcaagagggggccttagggcacaaaatggaaggcgtatgcttgccagcctgagaaccagtgcctccttgcattttacatgctaggcgcctcacttattgtgccctacatctagctctgctctgttgtatccactgcttatttcttaaacactctagaattttctttgttcctgtggcagagaacactgtctatcaaaatccttttcttttgcctcttggggctgtcgctagactatgtttcccaacccctcgtggagttaggggtggctgtgggcctgagttttgactcatggaatgtgggtggaagtgatatatttactacttccaggcctggccccagtaaacctcctgtagaagagtctctcactctttgtgtgtctgccaccttggtgcaggggatctagccctttctctgagcctctgtaggatgatggggccaccagtgaaaagagcttgggtacctaaatgagtttgtcaaagtcttcctgctgcaaatctccactggaccctgcttgagcaagaaaggaagttttgtgtcaagtcactgagacattgaggtttgtccctctaagaagctagcactgtgtgccctcaccagtacaggctctcttatctccaccagagtttctgaacataagatccaaaagggtgagagccttgtttacattgtatcaccagtgcccaggagagtgtctgttgcaggtatccaataaataattttttcaacaaatgcatcatataaatactaacataaaaacaactcgagagagtgctgaaataatgatatacataggaaatacattcggggttcaaaggggaaggagcactgtggatttcaagaaaatggggacttgagttagcttattttaaattttctttggtagagacaggatctcgctctgctgcccaggctggggtgctaactcttaagtatatggtattcactgtatataaagtggttcttacgtttcttagccagtaatgttttgaaaacatattccaaaggcatagggcagtgatttcacaccaaaagtatagaattgtaataacttgtagattttttaggcttttaataggattttaatcacatattaagtcatgtcaaatcatttttatagttacatgcctataactagaaaatattaaatttcttccctttatttcttactatgtccagtatatttgaactcttattttaaaaatgtcttaattgatgtaacagagaagtaatgtctgcttttattatatagtgtaaatcattggctttttcaagattcactagattgctttgcttgcctagttatagaaacgttagatggggcttggttgcattccttctaggaatatctgtgggctctaaggagagggcattgtttgacattgaactgttgatgggaaggatttttggtcaagaggaaggatttccaactcttttaagaagagaatctgtttttaatttcttggaagccttgagattctaggtatggaggaagacaggccagaggagatgaacacttctgctgatgaagtttctgggtggatgggaatatggagtgcatcactgctaactgtgggtgccttttccccaagaagctctcctgcaagccatgtgaggacagattgtggagtggcagcaggtaaccgaggttgtactatctagcagatcaagatacactcagtcccccagttgagacctagaatacgtaaaatccaagacctttattcctactcatatcctgaagtcactggtaaaataataccctacctaggttagcactaacaactcttgactagctctgccacaaactgtatatatatatgtgtaagagagataacttaaaggcacctttttaccatgtttcctgcctatttaaaataaaagtttggactatatgatcccaagagccgttctaccaataaaattcatatttctattagtcatttggtccagatgttcacactgatttaaaaatcttccatctcttaattgttgtgtaatgttgatccgattatttcatatctctatacctcagttttcctgcttttaaaatgggaataatagtagttatctagtttataattttgtcgtgagaattaattggatggtgtgtgccgagcccttggaacatggcaagtgtgcggtgaccattagctgctgctagttgaatttcccagttgcttactctgtggacattttcttgcttatatttgcttcccataacaggttattaataaattctccatgctttggaaagattccctgaaacactttaaaattcattctaattccagtgaattactaaagtaatacttctaaaatatataggaatttgagaaaaggtacaattttatcaacattgataaacaatatattaagtattaataaagcatatattgatcatgattctggggaatacatccctgttggaagtctgtgtcaaaatcataggtaagtttgagtttctcacaagaacgagcttttacttttaaactggctgcttctggtgaagaatagaaaatgtgcgtgtacacagaggccaaattttgctagctaaggtacaaaatatacttataaaaagtaatcagttcatagaaacatgcaaatctagatctctaagtctgcatatatttaatttcctggctttctatatgatccagtttctgtatgatctagcttgatataagtaggtttgtttcactgggagaatgagtcattttagagatactccaccagctgaaaaagctaaatgttttcatagttattatcatagcattttcactacttaaatatacatacaaaccaatataacacgtgcattgctcagtttggtgcaagttaccaatgaactaggatggaaatgcccctgcctccaccaccctccaacccatgccaaaccccttaagaaacaaatttacttaaccctggttgtgcatgtgatttgagttctttggtgatagtttaattgaaagtgcagacttcagagaccagtcttgagctggagtcccagatgggagtcagctctcatcatgactatagtcttggaatatttctgggcctcatgttgaaggaatggatctgagtattggatttatactacctctcctgtttctgaatattcactgtctgtgtttatttactggaatggtattcagtaccatttagatgctccacttgtcctttcacaatgtcttatatcccagttctgataagaccctgagtcttctgccctgctctcaaaccattcacgcattgctatttttattgcttaggcctttaggtaattggtagtgttcttaacatttcttttagatgatttgacttccagtctacacatcttctgacactgcagaaagcagccagttccaaagaaaacattttttgtagccgttttttccccctgctggtggaactgcaaaacctcaaaccttcactatgccaaatttggagtcttggttgctaccccttcctctcccctccagctacctttgtcatgttcagtctcaacttggtgactgccagtggcacacattctagattattttatagtaataagcatcctatattaacatttagatgagcttttaaaaagtcaactacttttattccctcccttacaatttcaattagtttttctctttcttcaccaaatttattaattttgaagttaaagggtacagtggggctagagaagattttgctcattgcttaaagccctgcagtgttcttcagctcttgcatacatccttacacatggttttgattttatggtataagagggtttttcacttcttgactcatttgtggcatgttgctgtagccatcactgtaattaatctcctaggaagaaatctgaaggttcaagtcaattaaaaaaagtgaacccaggaacaagtagcttagcaacatttccccccaacccagaggattcttttgtccttggagttggaggtagtctttctctctgatcttgaagagcatattcggccacttctttccctgcctcaccctccccactaccaacgtggagggtggtgagagggagccagagttcaggtcctgttcaacatttgctagatagtggcagccgttttccctgcagactgtttcagttatccatgcttgcaacttatttctttgctttgttcattccaaatgggattttattaatgccaccttgcctccttttgttacttcaaaattaaaagtgaggttttcttttttttaaactggaaataaccaggaacatagaatagtaaaataaaaatctacatacttatggtctagaataaaaaaattaatatatttccatatttactttatcaatctatatatacatacctttattacttatttttaacaggtaaactatagatatttagaatgatcctatgaaagaaacaggagattattcaaaatcataaatctcactcttgcacaaactcttctaaaattaagcattgttataattaaccgatccatacctcaaatccaaaatcttatgaaaaccaatattccagcaacttactttcactgggaggctttttctaggactgtggaaaatctgaaaatgcaataggtataaaacaaatagatcttagaaacaaaagtggtttgaaggatactgaaggtttcctaatgttgacttaattatagtagaaaaagtacaacagtgagtgatctgtgattccccccaacccctcctgcatgagattatggaattatatacataatagagagaatttaagttttataattccaagcttagggtacaaaagaaacaggatggaaatagttttggggggttctttctaaatgttaggattttaaaggtacagtaaagcctaagatatatgtaactctatagaatgtgtcatttgcccaaaggattataaatcattctgtaaagacacatgcagttgtatgtttattgcagcactgtttacaatagcaaagacttggaaccaaaccacatgcccattaatgacagactggataaagaaaatgtggcacatatacaccatggaatactatgtagccataaaaaagaatgagttcatgtcctttgcagggacatggatgaacctggaaaccatcattctcagcaaattaacacaggaacagaaaaccaaacaccgcatgttctcacccataagtgggagttgaataatgagaacacatggacacaggaaggggggaacatcacatactggggcctgtcagtgtgggggcaaggggagggagagcatgaggacaaatacctaatgcctgcggggcttaaaacctagataatgggttaataggtgcagcaaaccaccatggcacatgtagacctatgtaacaaacctgcatgttctgcacatgtatcccagaatctaaagtaatttttttttaaaaaagatgcatgtattctttaaaaaaagaaaaaaaagtcccagccaaaaaacaagggtcattttggaaagctaagattccaggtagatgaaaatgaatatatcgtgtggttgggctgatgttattttatttattttattcttttattatactttaagttctagggtacatgtgcagaacgtgcaggtttgatacataggtatacgtgtgccatgttggtttgctgcacccatcaactcatcatttacattaggtatttctcctaatgctatccgtcccccagttccccaccctccgacaggcctcagaagtaaagtacttctcagcaaatgtaaaagaacagaaatcacaacaaactgtctctcagaccacagtgcaatcaaattagaactcaggattaagaaattcactcaaaaccacacaactacacggaaactgaacaacttgctcctgaatgactactggctaaacaacgaaatgaaggcagaaataaagatgttctttgaaaccaatgggaacaaagacacaatgtaccagaatctctgggacacatttaaagcagtgagtagagggaaatttgtagcactaaatacccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaatcagtgaatccaggagcgggttttttgaaaagatcaacaaaattgatagaccgctaacaagactaaaaagaaaagagagaagaatcaaatagacacaataaaaaatgataaaggagatatcgccaccaatcccacagaaaatgaatattttaagtgttggaactttaagaaacacatcaattttcttaacattactgaagtgctatggttttaatacatgagggtaagaatcacgagattactttgtgactttgttctatctagttgcagctataatgctattgtgcaactcagtgagggatgcaaagggcagtagaggttgacagcttagctccactcccccttgtcagtgttctggagttggctttcttaaaagtcccccatgactttcttacaagctgatgtgaaacacataatgagaggcaaggtgcttattggatagcatcctaggtcacagctgtgtgtctttaggaagttgctcaacctctcttggccttaattttccaacctgctaaatgaaggcgagtagtatctacctccttaggataattgtgaggattcaatagcaatacctaagaagcacgcggcatagtacttagcacataataaaggcaaaaagttctgttaattatcttctgcaggattatttaacataatttgttctctaaagaatagagaaaaattatttgtgtcaatctcttaacctgccccattacctcgaatgaatattatagacacagtaggatcacaggctgctgctgctgcttttttttttttttctccctgagccggagtcttgctctctcacccatgctggagtgcagtggcatgatcttggttcactgcaacctctgcctcccgggttcaagcaattctcctgcctcagcctcccaaatagctgggactacaggtatgtgccaccatgtctggctaatgtttttgatatttttaatagagacggggtttcactatgttggtcagggtggtctcgaactcctgacctcaaatggtccacctgccttggcctccaaaagtgctgggattacaggcatgagccaccatgcctgaccacaggcttccaaaaggcatccacttcaattgaatgaatagaagcactgctcagcagcctttcaagaattttcctgagcatctctttctacaactttaattttgttaaaaaataattttcctaaggtattttgaagagcatatatggtcaagtgtgccaattcttcatcattatcacaagatagcacttctttcaagacatgaagtcacaaaatccccagagtctccttgcatatactaggcatggcctctgacatatgaaggattaagaattgcttaaatatgtgtaacaggattgaaagctttgagtaatgtcttctgttacatgattaaatgttgcattcactaataatacttcatatcctggataatactgataacaagtattataatgaagagcaggaaggtgataaaaatattaccaattgctcgtcctgcatctttggagtgaccactggcaaggaaatggctttctggcagctcagccctgcttaccactcatgcctctacgtgctactttctgcttctgactcatggagcttctaggctcatttttatgattttctcctttctctctctttaacctttcttgactttttcccacttcagatacttggaatcaactattgtccttgggaatgattactatatatatttattttttcagttatatcttctgactgggtaaaaggtgttttgcctgcacaactgaatggtttattttatttgtagaaaacctgtactgtgaattgcccttaacaattgtgttgggagggggaattaatagggtgaatatttaaattcttgtttatttcatgtgtaacttggcaaaattgcataccctgatatgacttgaattatagacttgaagcatgcactgtttcaaaccacgggtgtgcctgtgtagttaatagagcagttttttttgtttgtttgtttgcaaatgatgcttttgtttcaaggtgcccaatttcaggccaagaaaaaagtttgcatagcctgatatgttacaagattattctttccctaaacgaatggtttaagaaaatggtcagtgaccattttctttgctagtcttagttctctttatttttcccctttatatcatatcatattcacatcttaatggtttagtctaccactgaatacataattttctttctaatcttttgaatagtctaaaagaagtacttgttaaatgtttcatggtgtatgtggtgtgagaaaaatctataattgttcttgatttggacatttcacaaggcaatcaaaccccagatattataagccaagataaatgatagcacattttatctttgcatttgtgaaatcttattacactgttctgcaaatgtataaacgttttcttttcataaagccgtaggcctaaattatagctgctcattaacaaatggtttccatactcggaaatgtgtgcgggcaagccttattcaagcagcagcagctatcatttgcattgtctggagtagtactgggtcatttagcatttaacaatacctgtcttggctttttggctctctaagaggtgtctcatgttttattgaatatttacttatgtatgcctgagatgtagagattctccaattcagtgaataaagttgacaaggtaaaaaggaaaagacctaaaaagtagctatgttttatattacacagtttaattccaaccatataggtggttggagatatattccggagtgtcgactctgtggcaggctgaatgcagtaaacagttagcaaattgttcacatgttttcccctgcaacacactaatgtaagtcttttcagatgtatgtatcagtataacatatacagacaagatggctatcttttaatgtccagaaaaggtgaacattactcagttaaccttgtgttgcagctacatatggctcagacatatctgccctcccaacaaaaatgttgtaatatttgtgagtttcagtatttgtggatagtgaatgaaacatacttctttatactcctgaatgtatcatattatataataaacagagaaaggaactaatgttctccgaatgtttgaattttgagcccaagtgtctaatacatggactaatgtattttaataaaaatggtctaataaaaacattaatgttatttcttgacctatacaggaattttgacttttgggtcatagccattctgactgatgtgagatggtatctctttgtggttttaatttatatttctctgatgatgagtgatagggagcattttttcatgttggccgcttatgtcttcttttgagaagtgtctgttcatatcctttgcccattttttaatggagttatttgttttttcttgttaaattgtttaagttcctcatagattctagatattaggcctttgtcagatatgttgtttgtgagtattttctcccattctgtaggctgtgtgtttactctgttgatagtgtctttttctctgcagaggctgtttagtttaattaggtcctactggtcaatttttgtttttattacaattgcttttgaggccttagtcataaattctttgccaaggctgatgtccagaacagtatttcctaggttcttcgaggattcttacagtttaaggtcttacatttaaagctttaatctatcttgagttaacttttgtatacggtgaaaggtagggggtccagtttcatccttctgcatatagctaaccagctatccagcatcatttatttagtagggaacgcttctacactgatgggagtgtaaattagtttagccactgtggaaagcagtttggagatttctcaaatagcttaaaacagaactatcatttgacccaacaatatcattaccacgtatatacccaaagaaaaataactacaaaaaagacacatgcacatgtatgttcattgcagcactgctcacaatagcaaagacatggaatcaatctagatgcccatcaatggtgaattgaataaagaaaatatggtacatatataccaggtaatactacacagccataaaaaggaataaaataatgtcctttgcaggaatatggacgcagctttaggctgttatcctatgcgagttaatgcagagacagaaaaccaaatactgcatgttcttacttaaaagtgagaatattgggtacacatggaaatgaagatgggactctgagagtgcacagagaggggggtaattgaaaaattacctgttgggtactatgctcactacctgtgtgatgggattatttgtaccccaaacatcagcatcatacaatatatgcatataacaaacctgcgtgtgtatcccctgaacataaaataattacaaaaaaacacaaaacctctccccagaaaagacttcttcccatcctgatcacttcctaaataaatgcacttagcttttcttttttttttttcagacaacagaatcagtgatattttgactgtaaacccactttaggtaggatagtggcataaccattgggacctaataagcttttcatggagcttggattcatagaacaaaaaatctattaagaccctactgggtatcaggcattgtgctagaagtgattagtattactattattatttataagccagtaaaaacattgcttttgtattgactttttttttaaaagtagaaaactgaggtttttaaaaacttatttctaaagctgagtttgataataattcctggtcattaagacaatgttttgcacaagtaactctttcatttcactgttcttgcctcccagagacttctttcctttcctcatccctgctcggacagccagaaccagcctgcagaacttttacattcctttgcttcttgcctggctatcacagttgtaaagttcagccaagttgccatgggtatctctttaattttctttcaaattaaacatggaatgagagaatgttggcatgcctcaggacgagaggtgctaagactatcttttttttttttccaagatacttttttcccccaaagtatatgagtaaaaaaatagaaccaaattaaccattctgtagcaacttagcaaaagagtagacacaattttaaaaataatttctcttttgttccttagtatgaaccaagtatgacttctttgacactgttagagaaataaaacagatgaaatgtaatcctttaccttgccagacccagaaagaccacaatggaggtctctatatgggcagaccagtgcctctcactgagttgttgttcctgcttttatctctctgaggcttgtactaaaaaacatgcaggattttaaagtgacaaaacattaacattctatgtaaacagagcaagtattttaatcaaaacaaacttcccgctacaaattgagtacacttacccttaaggtttaaaagccccatttatcaaggcacttgctgttccataattgctcttatcttccactcttcctcactcacaaactgcctgaggctgtttgcagtttcacagcctttatctgaggctatttaatgcctcttccccatccaatagtaatacaactgtttatttttgttgttttttttgtatactcaggatgttttagccgtgtcctttataagtgtttatttcatttgctccttgcaacagcagtatgtggttgatatggagtatgaagctcataggcaaggggttaaaggagcaaagatgtgaggtgagaagctcttacagctatcatgtgaaggaaggagggtctaaagctgggcctgactccaaacaaagcctttgattcccagtttcccagttttgtgctgcttgctcatctgccagtttcatgcatccttcatctgtgacccttcattgttgggccattgttgccccagccgtaaagccatactgcacttaccattagtgaatcctcctgaagcactcattggctccttacttctccaagctccccactttgtcatttgggttccctagctgtcagctatgttaatcacaaagttgcttcaattcttttttttacagctagttcatccatcttattgccattctaattaacttggcagttaatgagcacggcacgggtattgagctgtaatgagacttgggttgcaggtaatcatgactcttttctggaatcttcctcttgtgaagactgctcgtctcatatctccggatttccttgaagggaagggctgcttctcattactctgtagccctgcttagttgttatttcctactgtcattattggacagtctcctttgtagtctactgcattcattcatgctgtcttcccccacgttatcaccagtccacagacctttggggtcttccttcatgatcctcctttaacttcctcacccttagctcaatagggtttctttaaactcagcaccagtaggtaccatgtgggtgactcaggagagcttgtccttgattttcttttcttctcaattacctgacgaagtgaccttgagacccttcaatctctcaattctgaaatttgtgtctcctcttgaatacaatttacattgctgaactgttccttaccatcacttagatgcacttgttctttggccttgttgtaactacaggtccttgaatttcattctggttatttattatttttactatttttttaaacactgttagatattggtagacccaggattctaaatggacccatggtcatcttccaggctgccatctttattatcctactcccttcccctttgacctgttgtgatgccaaccccctgctgcctagggaggtttaatgtgctttttggtctcagttgggatttactctccttggagcctctttttccatcattggttttggactctttattgcatttccccaatagtgactcttccaaatggttttctgtagtattgatctttattctatggtgtcttttatcactctgataacaaccctgtcacttaatttactaataagattaaagatgttcactgaaagcccactaatcttttctctcattcccaccacacttgcaatttgctgttggcataacccactgtcttcttaaaagctgctttattcatcaattcttctaaatttatttttttcttcctatttcagatgaaggtggggcctgttgcttttgctgttggtctcaatttctcttctaaaccttgttcttggatatgatctcttccatgtgtatcttctctcattccccagcaccatctgcttttttgttttcaaagagttttaggtattcttaatgtcatacattaaataaaaatgtcctttgactctacagcccttaaaacgcagcatatttgctcttaccattcttttctttgtccaattacttaagggagaaattattatcatcatagggctcttcttttttttttttttttttttgccactttttgttttagctctttctaaaatgttgtgaggagaaaaaacctgatttttgttcacatttcagggatctccttctcaattgcttaactttcaaatctctctagacaagccccgcattttcctttgatgctggaaagctcaatgtacttggccaactagtcctaaattgatttcttttctgtacaccctgccccagacaaaactaaacaaatgtaaaaacccatgtctccaaattactgttttgctcaacatttgaatttgctgttgatttgagtgatacctcagttcttttctacaggttggcaatttgacatcttcaaatattctgttttagacctccacaccccatctgttaccaacacctgctatgttttggttcatgaggaatcaaatccaccctttgccaaatttcacattatcagcactcctgcccagatcaatattttagccatgattattgcaaaagtctcgtaactaattttcctctgtatttgtcagcccccttcctccattagttttacacctcaaaccacattagtcatcatctgattactctttggtcatgttgttctcttgctcagattttggatcttttcagtgcctggaagatagttctcattttcagtgtgatatttcatgttctgcctggtctggacccaatctacaactttttttctgagaccatcggggatttactctgggcattggctgaacagcagcacttactattccgaagcctgccttgggttttttccccctgtaccttttgcgttcatgttttttttcttgtctaaagtgtctttctttctcttcatctcccttctgattttgaagtctagcctgtaagacccagtctagatgccttcagtggagaagttcatggattaaaaaagggattttcaatatttataacacactgtctgttaatgtagctattttaatgcctgtttatacaaccttctggttggttgcttttcgaggacttcaaccttatctattttcctatttctcagagccttctagaaatgggtgtttagtattatttttcttgattaaccccttgattatactatttattatttgacagtgagaaaggatgtctttattcaggctactataacaaagtaccatagactaggtggcttgtaagcagcagaaacttatttcttacaattctggaggcacaggagtccaaaattggggtgccagcatggtcattctctggtgagggacatcttggtttgtagactgccaacttctcattgtatcctcacatggcagaaagaccactaactaactctctggcctcttcttctaagggcactaatcccattcatgagagatctaccttcatgacctgatttacctaccttcagataccatcacattcggggttaggtcttaagaatgtgaacttaggggacacaagcatctggtctataacaaagcatacatgtgcttgacagctcagttgtcactgggatgctcctaaggttgatgggaagagacagagttgaggccagcctagagtggaggctggatgggtgggggcctgttcattatctggctttgttttcccttttgaaaggtaccttaagacaaaccacctttcaaatattgttttccttttttaaattcatatatatatttatgaaaatacactttaagcattcttttattctaagcactaaagccagattgcctgggttggaatcctggatttactacttagtagctgggtgacgttgggtaagatatggaattctctgtgcttcattttcaccccctgtataattgaactcataagatggttatgaatactaaatgagttaatacctctaaaacaagcattttaaacagtatggcatgtagtatattctcaattactgggaattaatattactattaagtagtgaggaattgctgcaagtaaaagggggaggtattagaacttgtaatttctaattagttttccagattattaaagtgttgtggtaatatatgaagatgagaatcactgatctaggaacctgtaaaatacagagcatagtgaaagagagaataaatggaaatgtcaggaaaaatgattcaatctagccttgtgtttgttttgttgtcatatacactagaagactgatctactgatttaattatttaagccgttcaaaatgtggatactaatttgtgatgtctactagacacttagcaaagcatttatcaaataacttcctaggtactgataatataaatacaggcatacttcagagataatgtgggttgtgtttcagaccaccacagtaaagtgagtcacacaaatttttggtttcttcgtgcatatgtttacactgtgctgtagtctattaagtagccaatagccttatgtcgaaataaacaatgtacattctttaattaaaaagtactttattgctaaaaaaaaaaacccactaacaatcatctgagccttcactgaatcataatctgtttgctggtagagggtcttgctttgatgttgatggcagctgactgatcagtgtggtggttgctgaaggttggggtgctggtggcagtttttttaaaagaagacaacaatgtttgccacattgatggactcttcctttaatgaaatgtttatctgtagcattgtgttgctgtttgataatgtcttatccatagtagcatttcttttagaatcggagtcaatcctgtcaaaccttgccactgctttaattaatcaactacatttatgtaatattctaaatcatctgttgttgtttccgtgatgtttatagcattctcaccaggagtagattccatctcaagaaacactttctttgcttatccataagaagcaactcctcatccattcaagttttatcatgaaattgtagcaattcagtcacatcttcaggcttcacttctccatctagttctcttgccatttctaccatgtctgcaattactcactccactgaagttttgaacccctgaagttatacatgagggctggaatctacttaactcctgataatgttgatattttgaccttctcccatgaatcactaatgtttttaatggcgtctagaagggtgaaccctttcctggaggttttcaatttacttttcccagattcattagaggaatcactatatatggcagctgtagccttatgaaatatttattaaataataagacttgaaagttgaaattactccttgatccactggctacataatggatcttgtgttagcaggcatgaaaacattaatctccttgtacatctccatcagagctcttggttgacccaggtgcattgtcaatgagtagtaggtctcaacagcgggcttaaaaccttcagtaaaccatgctgtaaacaggtgtgctgtcatggaggttttgttattccacttatagagcacaggcagagtagagctagtataatttttaagggccataagattttcaaggtgtaaatgagcattggcctccacttcaaatcactggctgcattagcccctaacaagagagtcagcctgttctttgaagttagacattcacatctctctagctatgaaaatcctgggtggcatcttctcccagtagcaggctttttaatctacatttaaaaatctgttttttagtgtagccaccttcatttcttcattaaatcttctagacaacttgctgtagcttctacatcaatacttactgtttcactttgcactttcatgttatggagatgacttctttccttaaacctcatgaaccaacctctgctagcttcaaatttaacttctgcagcttcctcatctctctcagtctttgtagagttaaagagagttaggatcttgctctggattaggctttggcttaaaggaatgttctggctggtttattcttctatccagacttctaaaactttctccacatcggtaatatggctgtttcacctatctgtgttttcactagaatagcacttttaatgttcttcaagaacttttcctttgcattcacaacttgaggggcctagcttttgacctatcttggcttttaacatgccctgctcactaagcttaatcacgtctagttttttatttaaagtgagagatataggactcctcctcttgaatacttagaggccactgtagggttactaattgtcttaatttcaatattgttgtaccacagggcatagggaggcctgaggagagagtgagagagatggcaacagttagtggagcagtcagaacacacaacattgattggtcaagtttgccatcttatgtgggtgcagtttttggtgccccaaaacaattacaaaagtaacatcaaagatcactgaacacagatcaccataacagattaataataatgaaaaattttaaatattgcaagcattaccaaaatgtgacagaagaagggagctcatgctgttggaagaatggtgccaatagacttgacgtaaggttgccagaaaccttcaatatataaaacaacaaccttcctcccacctcacccccagcaagaattctgcaatatctgtgaagcacaataaagtgaaatgcaagaaaatgagatatttttgtaacacgtggtctttgttttgggaatgttcaaacttgtgggacaaatgggtaaaggtatagctacagcctaacattgaaaagcgccatggccacaggcatcacacaggtctttatgatgtgccacaggcttccttgcctgaatgacagttcaggtcttgacagaaatggttgtcataggtgcagaaacttgaaagatggtcagttttgcagagggggcagagaggatcttttgctatatatgttagcatattttcagtaaaccatgctgtaaacagatgtgctgttatccaggctttgctgctccatttatagcacacaggcggaatagatttagcataattcttaagggatctaggatttttggaatggtaaataagcattggtttcatttaaagtcaccagctgcattcctaatgagggtcagcctgaagtggggtgttttttaggttttgggttttatttgcttaatatctctaaggatagcaaatcacctgtattagtttacctggcatgaaggaaatgcccattgctaattctaccaaattttcaaaaaaatactttggattttagaacaaactgaaaagttgctgtctaatacttggaggacagtatgcctagattcataagatgcctctgggtctctatctttgtaatatatttaccaaaatcatgaaaaatgtttttattagccagcatatagatagacttggtggttcccaaacctgaaaatggtgaaagtaacccagggagcatttggtgactcaagagcccagttcccaatccagcgaaactgaaacagtctcttctggggcaatctcagattctatgtctaggaatcaaaaatttaagaactggtgaggaattgcctgtaatcccagcactttgggaggccgaggcaggcagatcatgaggtcaggagatcgaaaccatcctggctaacacggtgaaaccccatctctactaaaaatacaaaaaaattagccgggcatggtggcgggtgcctgtagtcccagctactcgggaggctgaggcaggagaatggtgtgaacccaggaggtggagcttgcagtgagccaagatcgcgccactgcactccagcctgcgcaacagagcgagactccgtctcaaaacaaaaacaaaaacaaaaacaaacaaacaaaacaaaaaaacaaaacaaaaaaaagaactggtgaggaatcaacagtcactataaatttgtgctaccgatgtggtaactactaattgtgtctgtgttactatgaattcatacccaaaggtgagactaaacacagtaagaaaaccccccaaaaaaagagttgacgcacagtaggaagtctcaccaaattgttgacttgttcttacctggtggcttacttatactaagaaggagttttaagagacagtaattcaaagataatagtacaattcagaaaagcattctaaagctctattgctacttctagatactcaggtaatcttttggtctttctgttatattgtttccttggaaaaggattcaatctctctgttccccagctcttttttctcttcctactaaataagcaaaggtcaaaacttggaagatgtatttccctggaaagaacattcaatcgattttattagttaatataaaacatttatgtgttatgataggatggaaagcaaaacagtatttagggaaaacagttggtaatattgctcaaatcatgaagataataaagcttagcttctgtgtaggagtgcgactggtcacaggttatcacaagattaagtgttctgtgcgtgcacacccatcttttcttgatatttagtgcacttcacagactggccatttcacaatttgattatcacgtagctttgaccataaccagggcacagcaaaatctcctattttgatgctactgtggactcacaacttcttggctgggcctctgtaattgttattctgagtcttaaatagaagggccaaaacaggaattgagaattttattatgaaatatttcagtcaaaccacaaataggagatacctcctacacccataactcagattcaatgttttaaaatgtttttctgtatatgcttcatctgtcctctcccttttgtctcaggcaaagcgttttaaagcaaatctctgatatcatgtactttatcctaacatacttccttctttatgtataaaatcttcttttacaaccacgatgccatcataacacttactataaaaattaacagtaattcctcagggtcactgaatacccaccgtaaccaaatttctcagactattccaaatatgtgtgtgtgtgtttaaaatagtttatttgaatcagaatcttaggtggggaaaaggatattttaaagacatatttaaagaacactttattccttatgtaattagaacaagtaaggaggggaaaaaaaacccccagaacctcatgggatttcttaaatattttgtagaaggaactaatactttctttcaattttctgtccttaggagcattatgatctatcccctgagaatgagcgatccgatgcactttttaaacaatgtaaaccacagtttctggtttaatgagagattacttttcacattgcattccatgtcagcacagatgccatgatttcatgttctaaagttagtcctgcaattactgttttgattgctcttagaaaaatgcacacaaagaatacagtgactcagcgaagggtgttgccagtgggttgtagtttttagttttcagatatgatggaattgcacaaagaatgtacaacttggtgttgcattttttctactccccatgcctttctttccacacatggccaccagcaccaagcatgcccagcctcctttccaagacattgaaaagagtctggaaaacacagtatacaagtaaattgtaaaaactccatagcaagagctgctttttaataagaagctctcagttctcttgtcatcacaaagacttgtaaggctatacttaaaaaatataattcagtgactccaaagaggtctacttttgaaaataaattgatgcccatatggcacctcagtctctggggtaattgaatatttttattcaaaatatgtgagaggacactctgacttgaaaaagacatggcacctgcctctcaggcatgcttatcttacacggagggatgaacacaggttatggagaagatcagtggcttagaggggaggaaggtagaatctgagaggccagctagatattcttacagtgattcaggcacaagttaattagcagctggactggggtcatggcattgggcaccaagaagagatgctagaaagctttagaaatatccgctcacattgatgacatactggaccttggagatgaaagaaggtggtggtgatcaataattttttgctgcagtatacaataagaaatgctagactgggcacggtggcttacacttgtaatatccacactttgagtggctgaggtgggtgaattgcttgaggccagaagttcgagaccagcttgggtaacatagcgagaccccgtatctacaaatttttttttttttttttttttttttttttgagacagagtcttgctctgtcacccaggctagagtgcagtggtgcgatcttggctcactgcaagcttcgcctcccgggttcatgccattctcctgccttagcctcccaagtagctgggactacaggtgcctgccaccacacccggctaatttttagtagagatggggtttcaccatgttagccaggatggtctcgatctcctgaccttgtgatccgcctgcctcggcctcccaaagtaaaaaatttttaaaattagctagacatagtggtataatcctgtagacgtagctactcaggaggctgaggcaggaggactgcttgagcccaggagtttgaggctgcagtgagctatgatgacactactgtacttcagcctgggtgacagagtgaggccctacctcttaaaaaaggaaaaagaaaaaacaaaaaccctgcttattatgcttctgaaaagagacagtaggttggtagggggaggttgattttcatttattttaatatcttaattttgaagtaatagacaaggggaaataatatgtatctagggtatgtgactaggacacaaaatagaaactggaattattgatttggaagataagtaaagccatttatccatttattcatttatataactacattaatgtaccagaaactgtattaaggtgacagaaaaatttaagagtgtttgctctcaaggagttcatcatttagtgagaacaaagacaaatgaatggatccttggatagacaatctgggaactatatgtgttattaaatgtttatgtatagtgatttgtaaatttggtagactcaatagatgttttttctgaaacttcctttcctcttctctgctttccttttctattcttgttttcctattatttttcttttttaaaaatcttaactttatagtagaacaagtgtgcaagatgttatactgaagttgttgaatttaagaggcaggatagggtcagagcttgtatttggtctatatgcctgtggtccagccatagctgtagctgtagctacaatctgtaccaactgtgtgatgatgtattgggtgactaccttcctttccctctgccccctactgttctctgccaatctaagtcaccattgtagctggtgggacaactaattgtgttacaggtaaggtgtggggcatcaatcctattctattccttttcttttttttttcctcttcttttctgcttgtgctagaaatggagaaagctagtcactatatccaaaagattgcaaataacctctgcagattgatgcatctcctgttcaaggtcattttttccctccttcacttacagagagaaacaaatcagaaacaaagttcactaaccaaaatttcaaactttaacattcccagtgtcagtaaacattgtttttaatctattcatttttggttgatattaaatgttcagtgtatgaagttacggccttttaccgttttgttttttatgtaatctcacccaggtgatacttgatgcttacgtttatcttatcttgaaagagcttttgcaaacgtaaagttttagtcttttaaaaaatgaattgacagtctactttgtgagtttttcaaagtgcatgggatgtatagtatttttaatgattggtaataaccattacaattttttaaaaagttggtagcataataaggccatttagttacactacaagaaaggaaaactcataatggactccatgtgtttactcttacaacttcctgagtcacgttttctgcaccgtgtaatggtgatccattagagatgcaaaatctttgcaatcttttaagtaccctctttatagccactatttgaaggaagattaatctggtggtaggttcaagcctataacaccatgatttataaatagactggttcaaattatgcttgttccagtttagaaatgtaacttagatgcatatcctgtgagacacaagaataatttaaaaatggaattgatggaacctgaacaaaatcaatcaatgggagaaactttctctccctgcttgtataaagtagtcatcttgatccttaaagaatattaatccagtagtataatcatcagtggcaaaatattcgccatttttttcagggacctcggacagccttcagtgatttcaatgaatgtgaaatatgcttgataaaatgtatcctattgtaatactataccttctgaaggaagcaaactcagtcattaacagaaatataagaaaaggaacaatttcataaaatggaatggcttttcttatgagttttaattgggctttcttagagttctgattttcttcaactggctggattaggagtccctccctccacccctggacccactgacttcccacagatgcttggatacacctttatcatagcacttacccagcattttggttttattttcataggaatcctaagtgagtaaggcgtatttaagccagcagatggatgattaaaggatggtgtgtgttctatctctagttaatttccccagtaatttctgggcatcacatgcagtcaccacatggtagtcattatggctttcctcccttgcctgggcatccactagtcaatgtctgtggcccatgaagtcatttaggggagccccatcatggccactgcttatacattacagataccaggcaggcaagaccagagtctagcttctgaaatgtcccaagttgctactgtcagggccatgctggcttccagatagagtcagagacactggcacccttcgaaacttgaagctgtagtttggtcacatgaatgaatactgcttgggtttctccagcagagtgtgtcctcaaccagctcatccagctgcagtttctcatcctcctagattggaactgaaatcaaatccagagggcctggctaacatcatatgcctagcttttttttttttttttttttttttcctatctatcccaggaccctactttcaaaacttctctctacaacccaggtaccaaacaaaattgacatggagctgagacaaaaggagagggtcatttctgttatttaaaaaaaatgtttgaactctggctgttagaaattagataacagttttaaacacatacttgtgttcctcactagattctgaactttacaaggacaaggactatctttatctttgatccctggcacttaagacaatgttaaaagagtcaaaattaattgaaggaagaattattgcaatgtctcagtcagacttaagagttttcacaactcatttcaagctgtaataactcctgtcgataccctcttctcatccactaaggaatattaaatatgtaaatattgctcaagttctatttcaggactccttttagtggaaaaaatgtttggtgcatcttttatttcccttgagtcatcattgttcttcttgggaatgctgtgataaatgttgtcttgcagattctttgcagtgtaagagctttgtggtaggtgatgcttcctgggcctccaaatttgtagcaaattaaaaatgatttttgtgggctttctcccccactcttctaggtgtggaatatatgagtagagcacatcttagctgttgattttgtatgcctacaggaatttactttcaaaaatattaatttgcattttgctatggtatttaaattgataacagccacttatgtgctaggtgttagcaataaacagcatctatccataatccttgcagcaatccttagaagggggttggatcactttgtaaagggccagagaggaaatattttaggctttgaagatcatatgatctctgtggcaactcctcaattctgccattgtagtgcaaaagcagacacaaacaatatgtaaaggaataagtatggctgtattcagataacaacattttacttaaaaacatgtggtgggctggatttggctggttggttgtagtttgctaatccctgatgcagaggatttcctttttaggcaaaaaaaaaaaaaaaaaaaaaaaaaaaaaaaaaaaaaagactcatgttaacagttacccaagtttaccctgctctagtaagtaccagcactagaatttgaactgacttcacgtcatgattcaaaaaaaaaaaattagatatttatatttgttcactcagttatgaatgtttggtacctgcaaggccctgtacaatgtgctatgaaagtgatagaggccaagtttacagcttcctatagtttacagggagaggtagtcaatgaacatcattcctctcacttgcccaagttatgaaggatgacaaggcatcatgatttccggatgacaaatgaacacttttcttacctgtaaagttggcaatagagaacatactacaacatatgagataggctgttccagttaggcacagacagtgtagacaaccacaggactccacatggaggccagcttctgtaacacttcagaaatggcaagcaaattcctaagaaggatggagagagctgctggtctaccatgcacagttccttgttccaaagttcccacacagagaactctcctctcctttggaaacatcagtgagagggaggagaatgtgaataatgtgtgaacaggtgtccactccccattaaggaaagatcaggagtgaagagaaagtgtcctgcctcctcctgtgcgatgtagagcaagcagtagaagggagagaataactaagttgctttgggatttacagtaaagagaaattacttccaggattggagaaaaggaagcaattgacagagaaggtggcatttggacacgttcttgaacaatcttcacttggatatgtgaggtgagggggtaagataagccagagaaaggaaatatcagaagcacagagcagtttaggggggtcaagaaggtcaattgctaggtcagagttaaggtgaccaaatgtcctgatttgcctaagactctgggtatcagtagtgaagatctcacatcctgggaaccgcccagtcctgggtgaaacagatggttggtctcttgagcgtcagcctaagaacttggaactcccattcgttgagtggtagaatatgtagaatggcttcatgtagggctggtcaaagttaccacaccctgaacttcttgatatggttacttcctgaggtgagtcactaggctgggaatgaaaggtgagaggccaaaagctgctaatagacattgggaactactgaaggtttttgaaaggtatgaaggttacattgactcttagagtaggaaatgtatagaaagaagctcggggactgtttaatataaaaccagtggagaacatattaggggtgaaataaaatattgagatgtattttctttttgagaaagatgaaatattaattaattatcagtccctttttattttcccatcaggctctgaaaaagagttatttagaattcaatccccaaaactatcctagtatgttcattctaatggatactgttggcttggaatgaatagttctataattgaacttttttaaaaaaaatataaatactttgctcttgtattttcccaaataaaaatgctttggtaataaagaatgcatttctagtaagtttcttgaaatttttacttaaggattgttttcattatcattattgtatgttactcctgaatctggtcattgtaccagatagatacttcatttggaaaagcccactgggtaaatcttatatggtggcttgttattggcactgaactaagagacggaatgaaccagatgtagatgtattcagtttaagcatctagacaatgtctttcattcaataactacttgttaatgagttaatcagttggataaatctaactactgagaatcccaagaggaaaatgtgacatgtttgagcatgtttgtcttttaaatgatgagctttattatttaagaaatatcagaagttgaacttaggtaatcagaagttttatgtaatatagaagtgatgtagaaatctgatgatttgaaaaaaccaggtgaagtttcacaaaactacttcatattaattgctatagattcttaaaggaaattctgtcaattattttgatatggattggttggttattgcttttcccgcctatacttggattgactatattttttactttgaaataacttcagactttacagagaagttaaattatgcacataattcttgtatgccatttatccagattccttaattgttagtattttttttttgagatggagtctcgctctgtcacacaggctggagtgcagtggcatgatctcggctcactgcaacctctgtctcccgggttcaagcgattctcctgcctcagtctcccaagtagctgggactacaggcatctgccaccatgcctggctaattttttatttttagtagacatggggtttcaacatattggccaggctgttctcaaactcctgacctcaagtgatccacctgcctcggcctcccaaagtgctgggattaaaagcatgagccaccgctcctggccttgttagtattttactatacttcatacttgctatattatatatttctctattttttctgaaattttataagttggagacatgattctcaatatcagtgcacatttcctaaaaacaaaaaggacctcatttataatcgcaatgaatttattaaaataaggaaactagcactgatataatactgttatctagtctagataacattcaaattttgccaattgcacctctgctttttgtagttaaagaaaaaattgttttagatctaattccaggtcatatattgcatttagtggtcatactttattcttctttaatttggaccaattcttcagccattctttgtcttttatgaccttgacatttgaagaatcctggccagttattctgtacaatattcctcaacttggatttgtctgctgtttcttcatgatttgattgaagttctgtgtttttgccagggatacaacaaacatgctattgtgttcttttcagtgcctcatagcaggaagcacattctagggacattaactttgatcactatgttaaggtttcttgtttgtaaagttactagatttcccagcggaataagtatcttgtgggagatactttgatatgatataaaatcttgtttctcattgtatatttactcaatggttttagccagtgcctgaaataattattactgtaatgattgccaagtggtggtcttctaatttctcattaattttatattcattaactggaattctgcaaagaagagtttttggccaggtgtagtggctcacatctgtaactccaccaccttgggaggctgaagtggaaagattgcttgagctcaggagtttgagaccagcctgggcaacatagtaagatcctctttctttaaaaaaaaaatcagccaagtgtggtggggtgcatccatagtctcagctatgtgggaggctgaggtgggaggattgctagagcctaggaggttgaggctgcagtgagcttgtgattatgccactgtactccagccacagggacagaatgagatatatctcaaagaataaaaaaatcaggaagaccttttccttgtccttgtttacttatttatagcagtatagattcatggtttattttattcaatttattataatctcttactgccatttattctgttgcacacattgtcccaggatggacatggaacactgggacctcctttaaacttctctgtttgacatgttccatcattctttgaacacttcggttctctctggcacaatgtgttttaggtggatttttacattctcttccctagccttggaataagcatttctccaaggagctccttttagttgagaatggtatttagaaaacaaaatctggttgctggatatgctcattactgttggggtgttattatttctatgccttctcagcaaacagagctaggaagtataagtgtatatatgtatgtttgcttgtgtgtgtgtgtgtatacacatttatacatatatacacttataaatttgtttctgcttttattccatttttgagttgcttcttccctatccttgcttttttgagacagggtctttcttgtcacccagactggagtacagtggcatgatctcggctcgctgcccctctgcctcctgggctcaagcagtcctcctacctcagcctcccaagtagctagaactacaggtgtgtgccaccacacctggctaatttttgtgtttctagtagagattgtgtttttccatgtcacgcaagctggtctcaaactttcagactcaagtaatccacccaccttggcctcccaaagtgctgggattacaggcgtgagccaccatgcccagcctatccttgttgtgtttattatctgttgagtacgtaaaatattaacatgattctaaagatcagaacaatagaaagaggtgtgtgtgtacttttcataccccatcccttctacccttttcacatttgcctgtcactctgtttccacctgtccactgtaggtaaccaatttcttttgtttctcatttattcatcttagatatctttttgtacaaattaatagatgtgtatattttatttcccttttgttctgctatcaaaggtaacatacattagatactcatttgcactgagctttttttttttacttaacagtatatgttggaaataactccatatcagtttgtagattttcctcattattttttagtggctttggttgcagtgtactatactgcatggaagtaccacaacttatccaattactctcctgtgtgtgggcatttaggttgcttccagtagtctgtaggtgcagaccgcaaagaataactttgtgccaagtatattttcaggttaatatttttatttcattgaagcaactcaacttttttttaagttgtcgttggagagaattggagttatatatatgtcacttgtttttttatttctttgtaagtaccctcttttatttcttttgaatacctttgcaacaaaattgtcaaattcccctacttttaaatacagggacacaccgtatttggacaacacaccatgaaattttagtaatttaattcatgtttaatgtgtggtcaaaagagcccttatgcttcctgggtttttattatcttaggtaatctgagtggcttctaactagaggttctaaaagaatttgggtaactggttttatagctgtaattgagacacaactctgcataactctttccatccaccacttcctcctccccatacaggatacagaccttaaagaacacaagcctggccatctacttctccaaattaatacttgctcttttattgtcagtagccttagagacaatgtatttcccaaacacttgtttgtctaatatctattacctgtggccataacagagtgtcctatttatgagtagagccatatatattatggatttgcaaataaggatatttgcagagctgctctgcaacaccgtcagtaaccccacttttctgttcaactctcactacctaagaggaagccaatcttaattttatttttacatcctttctcttgtattcacattctgctggcttcttaactctgaatcgaaaatcaaagcgtatcattttagttcagatgccatgtgttgtgttttatctgatcctcatgcacttgaactcgggtttccttgacaaagactctcttgttcctgggtggattgactttaaccagaagctggtgctttctaagctctgtatttgaatgggttctgggggtaatgtggcatgctccccagggatgcttaaatactgggacatttttctcaatgtggaatttcctgaatttgcttaaagtgatataattttattcccttaaataactatgaagagagattgttcttagtatttctgaagagtaaaccaatagcagtatgaatgctaaaggagtttaatttgaaaacttgattgagtcattttattataagaaatcaatcaatgaatctccctctatcgcttcctctctcttcattcttattttagttacacttgtaatacataaatatatcctcaggtgtgtggggcagggagaataaaaagcatctctcttgggtctcctttatttcccttctccagatgcaactactgtgagtgtgtgtgtggtttttttttttgtttttttttttgacagttttgttcttgttgtccaggctggagtgcaatggtgcaatctcagctcacagcaacctctgcctcatgggttcaaatgattctcctgcctcagcctcctgagtagctgagattacaggcatgcgccaccacgcccggctaattttgtatttttagtagagatggcgtttctccatgttggtcaggctggtctggaactcccaacctcaggtgatccgcccacctcggcctcccaaagtgctgagattacaggcatgagccaccatgcccagcacaactactgtgtttttaaacttattgtttgtatttaagatgttcaacatgttttgatatgtaaatacagagcaaaatgattactcaagcagatttacatagccatcactttccatagttatgtgtgttaagagcaatgagaatataaatttctggtattttcttgtgtttatacctatacacacatataaactctcatacgtgtttggggacttggggattaaggggaaatgtttttcttctccagaggccaggttgatgactttaagaaaattactcctaaattttggtgctactattagaaaggggagaatagccattccttctgttgttggagacctgcttagacattttaactgttgctctctctctctgctatttgaaaaagagaaagacgttatgagatatggggactgcctctgaaaggtactaaagatggagcgtggctgtttgcctacagggtgggtgagattgggaattatggtcttgataggacttttgtagcatggtgtggggaggtgaccacctaaagcacatactggagggataaagtgtcagtactgccagctgtgtgttagctagaagatgtggtgggagttttgttaatggttagccaaggcctatggaagtcatcatggatggcagttcctctctcctttttgatgatagaagtgatgaagccatcattttttctttcttttttttatattttaagttctgggatacatgggcagaatgtgtacgtttgttacataggtatacatgtgccatggtgatttgctgcacccatcaacccatcatctaggttttaagccccacatgcattaggtatttctcctaatgctgtccctccccttgtccccaacccctgcccccgacaggccccggtgtgtgatgttcccctccctgtgtccatgtgttcttattgttcaactcccacttatgacatcattttttctttcttagcccattggcaatgagaccattagggccaccaaggagagggttaagtcctcaccttttaggtggaagatatgccccctttttctccctagcacactggagggtattagcacatcccttcaatccccatgttccccaagctgtttggaattagatgtttcccacctgtgttgtgaagaggagaggtttggcattcagtttacattgatgctttaaactgaaaaggaatgggccttaagtatggaggaaggactactatactaaattcctacttgctttcattcatagaatctgctcattctacttaggtcactgatacccatctgggaagtgggggctcagggtagcaaaaggggaaaggttttgagaaaaaagttcatttatttacatatcccagtgagtcagactgtctcagtaaattagttaatggtttgtttggcagagaagtacaattgatttgcctttcaagtcaatgatttatataacataaaattgttcaaaatggttgagaccaagccttagggatttttctctttattaatgttgcactaaattggggatattctgcataaatatcttgttaagttagactgtatgttcctggagaccaggaaccttattttattttctaaggagccaagtaaaagtatgtgctaaaacttgctaactgaaaggaactttattttagcaatatgtttcttgcacagtagcaaatgtctatatttgacaccaagtactgaagtggactctgggcacatgaaaatgtataggaggtgatatcttactgtctactggggaagacatacatatagctaggtaattttataatgtaacaaatatagaaatagaagactccagcgtgcctcagagtgatactatagtggcccttagcccttataagtgattagagtatcagggaagtcttcctggaggagattgcatgttcctttataggttagggaattgtatatcatttttatacttattattgtgttcctaatgtgtaggacatagcaagtaatcataaatgtttgtaaatgaataaacagatgtatgaaaaagagttcaaatgagtcttaaattatgaggaaaaactaaaaaaataagaacattgcaggtaaaggtattctaggcatgggtagtgatgagcagaaacaaactcgagtttgagactgctgttatgtgcacagatgagacatagctcagacttgagactagactttgttctttaggtagtagggaatacggtggatttttaaacagccgaagtgataggattttatttaattttttaaagaaatcctggtgattgtatagtggagaatgaattagatggatgtgagagttgggagcatgaaaggcgtgtacgttggtagagttgcccaagttctggagtgagaaatgtgttgataaaaatgcagaagagagaacagagtgaaagatactttggagaatgaagagtgataagagctgctgactgtggtgagggggtgagactctgagatgggacaaaaagtttttgttccctgagaggtaagaaggcatctcctggagagggcttctggaaaagctactgtttcttcttcctctttttttttttttttgtaatttttatgaacaaaatagatcaactggcatacaccacattcctgtctagggtgctctgcaacaaatgcctcctaactgccagaaggtctgggaaaacagtattttttctgtcaggcatgttgctgccctgaagagaattagtcctgaaggaagagcagccactagtaatgtctgacaccaagttacctgttagtcttactactgctagtagcactaaaccagagcacaaagtctacccttttaaagaacatttggaaaaaaccatcatatccccataagggactactatatttgtcagaaaaatgtcactattatttctttgaaaagcactcaatcagcaggtgctttggcagtttctaagactgactagtgttcttgtcacacaggttaacaaacgaaaaaaataaaaagagaagggaggcaattgtggtctttctcacccagcttgatttgagggcaaagttttttaaaaaaacaaaaccattaaaggaaagtttaaaagcagcatgtaaacatgtgactgagaattggctcagaccgaaaggctgagaagaccgaaaggctgagagaaaccctcaaagtggaacgcctaccttggagaatgggtcagctttgcagaagatcagataaacatagaaatgggaaagggttttatgggttgtgtgtgtgtgtgtatgtgtgaattttattttttttaccttaatttattattatttttttgagttggagtcttggtctgtcacccaggctggagtacagtggtgtaatctccgctcgctgcaacctccatctcctgagttcaagcaattctcgtgtctcagcctcctgagtagctggaattagagacatgcaccaccacagccggataatttttgtattaaagtagagatggggtttcgccatgttggccaggccgtgtttttttaaaaaaataagaatcagtgttgggtagttcagagttttgagtagaattcattttactaaacttggatatattcgagactatgtgattcatggatcagaaataaaataatcttctaccaagtttgcttctatgtacatctttttagtatttatttttagaatgatctatgttgtgttagctacacatacatatagtgctacaagtcaggttttaaaactctatcaagcatctatgcaataacatacatgcagttcttaggctggcatgaacgttgttttcttaaaatatgaatcattaaatataaaggccaaattcactaaaagatcttgaagatatgaaattcggagtactggcacttttaactatgggtgtttacagaaaatatatcttagcatttggaaatatttggaagtatttagcttacttccactgtgcatttatttttaatatttatccagattttctatcatgtgcctcctgcttttctgttcctatttaagacatttggcaaaggggaacaaagaaatttaattcttactgaatatgaaactccttaggcctggataatgtctgtattttttctaagtctggaaagatgtacattttagccaatgctggaatagcttaaactattaaaatcatacatgtattgttttgtctcttatgtaggaaagtactcatctgtggcctggttttacttgatgtggtctcagttaagctggttggctgcttgaggtctcctgtgttgacctaaggaaggtttgggaaatattggttaatatactacagtgtgagaaggatttattacaagtgccatgtgtcattactataggcattcttccccttgtaaaccaatactttatataagaatgtgtcatgataactaggattaattttcttatttttcctgggtaaaatgagactccccaaaagggctcaccttagaatgaggtgaatttttctgtcttaactctgattcttgttttctgccagatttaagtgaagtccccttttagcaagaaagtataaatatgaaatgagggtataattttatctgccattaagtaaataaaaatattatgcaaaataatttattttctttctacatcaaacaagttaagtttttctgaattgctgaatgatgcaagattctgtagactgagccttcaaattttaggaaagcttttattttggtagcaattaggaaaacaaatctaggaacttaaagattgtaatgttaagtgctgacagcccacagactactaacattcagctgtatgttttcctccctttgatttttggaggttccatgtaattgaatctttagttagaaatttctttatttccataaggttgaaattttccctagattgacaaatcgttcattactaatattaaaatgaaataaccatattctttgttttaaaattttgtttttatcaaagttgtacacacacattgtttggagacagatggttctgtcagacctgtaatgaaaaactgttcctttccaatgccttcttgttacttccccatccccccttgactactttcagaacctttgggtatttatgtttataactttccataacatgcttttattgctccttctctgctttttaatttggggcattatctactgaattgctgctatggaagagaagtatttagcttacttccactgtttctcttcctcactacacaagagcccacttcttttccccatcctcctagtagagttatattgtcattttgcagggatgaatagttggcatttatattcttataaccattgtattaggccattcttgcactgctgtaaagaaatatctggccaggtgcagtggctcaagcctgtaatcccagcactttgagaggccgaggcaggcagatcacgaggtcatgagatcgagaccatcttggctaacacggtgaaaccccgtctctactaaaaatacaaaaaaattagctgggtgtggtggtgggcgcctgtagtcccagctactcgggaggctgaggcaggagaatggtgtgaacctgggaggcggagcttgcagagagccgagatcgcgccactgcactccagcctgggcgacagagtgaaactctgtctcaaaaaaaaagaaaaaaaaaagaaaaagaaagaaatatctgagactgggtaatttatttttttttaaaggaggtttaattggctcgtggttttgtaggatttatgggaagcatggtgctggcatctgctcagcttctggggaggccttaggaagattttattcatggtggaaggtgaagtgggagcaggtacatcacatggccagagcaggagcgcgagagagagttgggaagaggtgccacacgcttttaacaaccacatcttatgagaacttattgccaggacagctccaagccatgaagaatctgtaccgcccactaggccccacctccaacaacacatttaaatgtgagatttggtggagacacacatccaaaccgtatcaaccttgcgaagattatccaaagctgagccacatagtgtgtgtatatgttaaatattggttacatttcctatcctatatagttattgttttctctgaaggtggttttttttctctgtgtgtgcttctcaaattcaactgtaaatgctcttcagtttgctaaatcccttcctagtatgtttgaatatattagctatcttattttatccttttggagagacacctttcagcattgctggtcttgcagcagtctagtctggctgctttatagcctgcttcacagacgtttacttgggatttcccatcagcataatcttggggaattccttctgcctctaacttgtgttgaatactctgttgcctggattcttttactgtttttgtgtacttccgtttttgtggagcatatatcctttaatagcttaccaagaaaggatacctgggatatatatatttgagaccctatatgccagaaaatgtctttattctgctttgcagttgactattttggatggtcctggattcttactagagattttctgtagccatatcctctttcccagctttcaacctcaggacgtgcactcctctagcatttgttacatctgactcctaatttcctccccattcttctccagcacccgagtgggtggtggaagttaggggcttgtgcctccgctggaatagtatctttcctttctctgcattctctcttcctcaccttcaaaagttatcataggtgccgatagttggcgtcttatttttcttggtgactgtcaaagaataccagagccagagagtagtgaaagtgattaaaaacagattttatccagaaattattgcaataggaggaaagatacctcagtatagaactgggctggatttcaaatacacaacgaaaagtggagatttatacacaaggagtggggctggtggggcggtgtttggatggaaaattactaagaggagacattaagggtagggggattcttgctaatctgacttaagatcagatatcaagggttgggggtgaggcatttgatcagatatcaagagtggtcagaaatccaggatgggggattctggctaacttagcgggattcttgctaggtaggcccaacaaggacaggggtcacagttgaggcctagtccagagcagagggctcagaggaacccgactactgtttgctcaaggagagagtctttgccatggttcaagtgaccataccacatgtgttcaggtgttagcaaaaattctcaagatagggtttgtgacacttttcatactagtgttatttgtgtgtgtgtgcatgacatatgattagaacgtgagataaatggtagtactattgacatttacataacctgctcaggagaatggtgatatgggttattttttcccctaaggctagttatgcccagccattaaccagattaaataatctcaatatgtatatacatcacaagaatgtgatataactttatgtctaaaatactttatcaccacagaattagaggatatacttatgctgcttctattatggccaagaaaccaacgtatgaatcacaggtataatatggggtacttttctacaaagaaaatatgtagcaagtgaagcatttctttttaatcaagaagtgggctatattatgctttaattcttatatggcccttagtttttccaggagcttattatttatttgtttcacatttgcatgcttttctgcagtgttcttttttccccccgaatgctccatcatccctaacttattccaatctaccgaattttttttcttttttttttttttattatactttaagttctgggacacatgggcagaacatgcaggtttgttacataggtatacatgtgccatggtggtttgctgcgctcatcaacccgtcatctacattaggtatttctcctaatgctatccctcccctagcccccccaccacctgacaggccccagtgtgtgatgttcccctccctgtgtccatgtgttctcattgttcaactcccacttatgaatgagaacatgcggtgtttagttttctgttcctgtgttaatttgctgagaatgatggtttccagcttcatccatgtccctgcaaaggacatgaactcatccttttttatggctgcatagtattccatggtgtgtatgtgccacattttctttatccagtctatcattgatgggcatttaggttggtcccaagtctttgctattgtgaacagtactgcaataagcatatgtgtgcatgtgtctttatggtagaatgagttatagtcctttgggtatatacctggtaaatgggattgctgggtcaaatggtatttctggttctagatccttgaggaatcgccacactctcttcaacaatggttgaactaatttacactcccaccagcagtgtaaaagtgttcctctttctccacatcctctccagcatctgttgtttcttgactttttaatgatcaccattctaactggcgtgagatggtgtatcttattgtggttttgatttgcatttctctaatgaccagtgatgatgaggttttttcatatgtttcttggctgcataaatgtcttcttttgagaatgtctgttcctattcttcatccactttttgatggggttgtttttttcttgtaaatttaagttctttgtagattctggatattagccctttgtcagatggatagattgcaaacattttctcctattctgtagattgcctgttcactctgatggtagtttctcttgctgtgcagaagctctttagttttattagatcccatttgtcaatttggcttttgttgccgttgtttttggtgttttagttatgaagtcattgcacatacctatgtcctgaatggtattgcctaggttttcttctagggcttttatggtcttgggttttacatttaagtctttaatctatcttgagttaatttttatataaggtgtaaggaaggggtccaatttcagttttctgcctatggctacccagttttcccaacaccatttatgaaatagggaatcctttccccattgcttgtttttgtcaggtttgtcaaagatcagattgttgtagatgtgtggtgttatttctgaggcctctgttctgttcctttggcctatatatctgttttgataatgattagtgtagtcttaagtcagtttactactttgaaagagtatgcagcaggctttgcttttggctactaatactaatctctactgaatggtagaagccccatccaatggggagaaattttagggcaagcctttgagcttgcttgagtgtaaagaaacagaaacaggctgatgaatttattaacagtggtggaaaagtataagggtgagtacaaaaaccaaccaaaaatagaaaaagaaagagcaaatctataaacatgagaagttaagtttctagtttaagttactagtattgatcaagggttacagcatccctgaggaagtaggggtggaaaatacaaataatctcaaaaatgatttaactaaatttgtagatgccagatccataatgggttattgtagggaactaggatgttttgggttcactcctaacctttggggttgacatcaaagaacagccattctttccacagcatatcccttggtgtcatcatcagaaacctggacaggaagaattgggagcctgatccaatgtagcaagacccattaggctctgatctgtgccaggtttgtgtgggttgtaaatttagagtaaattccaacatgagggttgtaaatgtcaatgaatgaaaacttgaaaaccttaacttttatattttctaatctttgttaattctcatttatgtagtgtgctcttaaagctttaactttcttggaagatctttttattatatatcctgtacttgactatagtgatacttcttgaactagtagtttctcatactataggttgaataggatcaattaattaccataggaatagagcccctacttttggaatttctcttacatatcactccattttcaatttgcagtttgagattataaaagaagtttctacttcagttatgattcttgacttttctaatagaaagatatttgaaattcccatttgaatggattttcatctatatgtaggaaaacacacatgtaattttagggtttttgggtgcagattatccgttttccttactattttgagggagaagggctgaattcaaaactttgatctgaatgccttacagcaatgtgtaggaatcaactgagaatcttgttcaaaagcagatttggattcaccagtagagtgaggcccgtgattctgcaatacacaaggtgtgggatgaggaaagtctgagattcagcttctaggtgatgctgatgctgcaggtttgaggaccatgttttgtatagcaagactttaaagcattgcttgccaacttagtgctgtagtttaaaaaaccagtcttggtttcagcttttccactaactatgtttttggaaaggtaaaggaataatgaaaacaaattatttatatgagcaggatccaaatactatagttatttggatgttgaattcgtctagaaatattttctttccacctattctgtattcttcccagctctttctctttttcttatttccattctgtattgaaaactggaggcttaaatgacacaaatctttcttgattctattaaacacacatactctttcagctctgtgtactttgcctaattactggcagtaaaactcagtaaagggatttaaggcttatgaatgttctacttggaggaaattgtaattaaggttattaaggcctttgggttcttgtattttaagcaaattaagactttatgtgttttttaaagagacagtaactcttccctgcccaattatttcctctgcacggataaccttgtacattccatgcatgtggttcaaacggcacacattctactttgttcttttaggtaagtcatggatttaagctgagaacttttttcttttctcaattgccatatatgaaacactggacaacttttaaagcaaaaactaagaaataatccatgtactttggtaccaaaattattttaaaagccaaattattcttctttaaaacatttgaagagagaataatagtcatttaccttttattgcaaaatcactctgttctctattaaagcaatatgagttcattgcaagacgtttatgaagtgccaaacacaataaagaaaactgattcatactaccttgtagtaatcactgttaatattttttgtcttttttgcaagattttttaaaatataaatataatttacgattttttgtgtgtatgtaaaaggttagaaatgtcctaagaccatacctatgggcacaaccaagtcactttactttctttcctttcctttccttttcctttcccttttccttttcctttcctttccttttccttttccctttccttttcctttttctttttcttttctttctttctttctttttttttttttttttctgggacggagtctcactatgtcacccaggctggagtgcaatggcgcgatctcggtttactgcaacctctgcctcctgggctcaagggatcctcccacttcatcctcctgagtagctgggactatagatgtgcactaccatgccccactaatttaaaatttttttgtatgtggagacaaggtcacactatattgctcaggctggcactttacattctacacttgaattagtttctatcttggtctttctttctcttagtcatggaaaatgaattctggtaaattaatcttgtgtcttgttaatgaatgttttctcatttttatttctgggtgtgctcttccttccttccctgccttttcaccaaggcttgcatcaaggtttgccaggggagggaaagcgatggagacctcatatcatcctgatgctcctgtcccctgcgtgtgctgaccttactgatcttcactcttctgcatctgctcccacgtcaacccctgcatatcacacattcatgagggctctgttcatgtgtccaggctctctgcatctctgtcctgactgtgaagttgtcttcttgctcgctctctaagacacttctgaactcttcttggagtgtaagatattttggatggcttactatactgcttcgggctcaagaggacatctcaggccctctttgccctgaacatcttactaccatgtctcgcgtcctgctcacataagtgtctgggatgaaggagcacccctggatgctgctgcttccttgggctttgcagctatcttcttgtgtttcccacatttgtcagggcaagatatgcattatcttttgttccatttcccgaaggttatagcacatgtacctttgtagacacccactcaaccaaaactcagtgttttcttctctccccactctgctgctgactcatggggtctttatttgtctaagcagataattggctctgaaagattacttagccctttatgcttatgaaaaacttttgctctgagtctttttttgtctctggtttttgatactcataattcagtatctcttttaattcttaatttttttttttatttttattttctgagacagggccttattctgttgcccaggctggagtgcagtggcacaatcttagctcactgcaacatccgcctcccaagctcaagtgatcctcctgcctcagcctcgcaagtagctgggactacaagcgtgtgccaccacacttgactaattttggtatttttgtagagatggagttttgccatgtcatccaggcttgtcttgaactcctggaatcaagtgatctgcccaccttaacctcccaaagtgctggaattacaggtgtgagccaccgcaaccagcctattcagtgtcttataatgtgataaaggaaagggaagatttttgtctcttccaagaattttaaaattctgtttggaaactcaaaatttgagcatttgtacttctttttcttgagaaactttgctttgagccagtgaattccacttgagcatttgaatgaagaaaaagctaagagctaaaaataaattttaaaattatcagttaatattcaaatattatttaatcacatgtaatgtgtgtgactttttaaaataggattctacactgtttttataatctaccccccattctatatagagccttgtctatatattaactaacactgctgtgcataatcagtggttctttgtagtcaatattttatacctaatgtaagttattcagtattttattcatggacatttaggctgtttactgtcctttcactattaaagcaaatgctgtgatataaattgtatgtatttctgcatttatccaattctttcagctagattcctagaagtaatattatgaaattcacatgaaatttctatgaaattcatatttcatagaagtaatattacaaaggaaaagttcaataattccaattctaggagatttataccaatttacattaccaccagcagcatataagatgttaatttcctgaatgcttaccaattgttaaaatcatcagtcccttaaacgttaattttatgtaggggtgactctttattttgatttgcattttgtcaataatgagattggatatattgtacatcttttcatgtctaattaatttctacctttttcaatagcttattatatttttacttccttttctgaaaggacttttcttcattttgatttgccaatattctttatacaaaaaaaatttaccattattgtatgtttcaatgaccttttctagtttatgtactttcttgcaaagaagtttattgtttcagtcaaatttacctttttctttatttttttttttttgcagtttatgacctttttagatagcctttcaggagactctttaattaccctgtgaacatagacttacattgagcaaaccattgtacaaagtatatttgatatattatgaaattagggtacattttaaatgtgtttataatagcttaatatgtattaatacatataatttaagcatgttacttatatgatgacatcaatatttttatgccatttcatgattaataattcacagtgaggagattgcagtggtttgtaagaggattgcaacctctccatgagttgagtgagctggatgttagtaagaagttgtctgtgataatatgagctctggtgtcttctgccctttgtggagctgaatcctcagaggccaggcagtcagttacttctgtgagtaaggaaggccacaggctacccaacagtgatgaactctgtgttaaatagatggattttaatgcaggcggctgctactcggctctggttaatgattatcaagcaggaatgtggaccatgccatctgattattagaaaaaaagcaagaaatttgggttttcacattaaaatttttctagagggaaaaaattggtgcagataaaacaaaattgagctctgtagtgcgtaaacatatatggtggccctagaaatgtttatataccaaggcgatgaactgatctttctagagaatagctaatttctccttttactccactcccttgggtgtatgtgtgtgcaggcatgtgtgtactgcatacgtgaatgcctatgtgtatgaacctagtgattagctctgtttttttctttttttgagtcaggcaaggtgtatttttaatttttttcatagatacggggtctcaaaatgttgctcagtctggagtgcagtggctattcacaggcctaattatggtgcgctgcagcctcaaactcttgggctcacgtgaccctcctgcctcagcctctggagtagctgagactacaggcatgtgcacagcttgattagctctgaggttgagctaaactcaggctcttcacagtctttatttactggctattttctccttctgccacattctttatttgaaatacattgttcttgggggtactatgaataaaaatgaagagtttttaaagaggaagaaatggggtttctacagtatcaagttctgtttgcctgaagatgaaattggagacttagtgattatgaagtaactgcaagaatgtgtctttgacaagacttttctgcagacgtgtactctctgttgcatcacatcagcaggcgtgtaaggcagtttgtcccattattggtgattctagttttgatcacttggttaatgtaagtttggccaaatctctccattataaaggcaacttttctcatttgtgattaatacataatctcttgggtggtatattttttcccaataaactttcaccaaatggtatttggatggtgatgatctctgtctgaattaagttattacattagtgatggcaaaatggtgaatctgtgtggccgcaatcattcaaatgtggattgtagaatattttacaagacaactagcctggagtctaaaaatctcagtgtcaacagaggcaaaaaatagtggaggaactgctctaaattaaacaagactaaaccgaatgcaatgtatgacccttgataggtttctaaagataggtgggaaaaaagcaatatttttggggagaaatgaagaaataggaatatagacaacatatttgtaatactttaagtccatgttaaatgtctgagatctggcaatggtattgtggttatgtaaaacagtgttcttatttttagaaggtacatgctgaagaatatagggtggtgtactgcgatgtctgcaatttactttcaaacagttcaccaaaacaattatgtgtgtgccttttcatctctacctttagatctgtgtgtatatagatatagacaaatataaatgttgacatacacagagggagagaatgcaagggaaattattttttaaataatgatagttttgatatgacttcgtgacttacaccaggtaaggtgtttatacagtgtttacaatcccggtgtcctacaatctttttcagaatttggagtttgtaaagttgacttttcccaacatattgaaaatcagacatttatccttctttcttcttgaattcctcttttttttttcagaatcagtttgccagtattaaaaaaaatctataaaaatgtaaataattagagccttcttgtctgtcttatattttaatatcttctccttaagctatgcttgatcttttccttttcactttgaaggtccctatttttaacagaccaaaaaaccccatagtcttcctatccctttcatctaatattacattataacttagtaagtgagcttaattttttaaaattaaacttgctttaaaaataatttttcataaatattaggaaactttaaccttcacatttcttttgatattattttttcccctgaatatatccttttgtacatgttgtttaaaatgtttgaattcatcagagaacttcctatgcaattgtgttgaattctctagaatatcactcttcttttcccctttgggattatgtaaagatgttcttattttgtaaatgtccttctaatttatattctaatttagaaactttggccgcaaacacaaacgtgtttcttctgaacttttaaaattatgttcttaaagtataggattatacttctaggatcacagtttctgtatgctattctaaaaaggcccataataacatttgatttctgtattaacagttcttccttgtattcaagtattgagtgactcctttcgtttttgctatttatgtgaaagataaatggccaatacaatcagccaaggtgtatcagacatagtaaactttttatccttgcattccccaatcctgtgcatacatctgtatgtttatgtacatgctgtaccttggacttggaaatcttgttccatcaggcaaactcctgtattctcttcaagacccaagtagtgttactccctatttcttagctcttccaggataaattgcatctcctccttctctaccccaaagcacttgatagtatgcacataaaatacaacttaaaaactacaatattttggagagctcttactgaacaaatctagaataatctgagtattaaacaaagacagtaacagcctatagcccattgaataacattcacgagtacctttctgtctgcttgtttgacgtaacaaacaagcagacagacaaatgagggagaagggaaaggcctccccaaaactagcatgcccactaataaatggagaggaaatgacggagttaaagaatcaccttcgacaacctgacagtaatagtttatttaggcaaaaatcatcaattcttggatgccaaaaccagtgtgtgaaaatttgaacagcaggatatttatacagttttactatgtcacctctcaaaatacttaccaattacagaagaaaaaaatagcaactttatagtatagaaacctagcagacaccaccttaaccaagtgatcaaagttagcatcaccagtaatgggaccaaaatgcatcgtgtgcctcttaagatgatgcacagaaaaaaacatcacttcatacattatcccccaaatatatgaccagtcatgagggaacatcagacaagcccagacagacatgttgtaaatcactgacctgttctcttaaaaactgttaagctcatgaaagaactccagattaaaggagacttggagatatgattttcaaacccatcatattgggttagatttcaaacataatatgatacattagcttaaaagggattctaatctaggaaaaaaataaagaactataaaggacattgttggcataattatagagtgaggattaaaaaataatatatcaaatatggttgatgtaaagcaatgtctttgtttttggaaatacatactgattactgaaaaattttagaggtaagagggcagaatatctgtaaattatacttaaatgactcagaaaatcatatgtatacatttgtatacacacatatattacatatgtataaacctacatgtctatatacatatctggctacatatacatacacatatagttttgccactttttgagaatgatcaagtaccatttacagttttccatgaatgtagatgcaggttgcttttggcttccaagaattggagaagatggaggagactcatggtcaataagcagtgacaaattcctctccaaaactgttcatttcattcctctggctttcatgcatttgtaaagtctagttttgatcatttgagtggtatactcaggctttctaattacataggtatgcttgctgtgttacttcaaaggccccttagccagggcaggatctatcttcaaagacagtgaggagagtggcccatttgcaggaaattgcatggtttgggggtgatttttgttttctttgaacttgtcaagtggagatccctctgtaaaaagtgctggccttttgctgaatgcccaaacagtaaaagactttccatttataattctgaagatttctctttaacctctgccagaggaaacttgtaactcagtttcccccattatcctttttgatggatcagcagttttactctgaagtgtttttgtgggtgatatcttaattttgttggtttatagttctagttgtgttaggaaaaattagcatagtatttttagtgactaatcatcaaaaggaactttgattattttgttgtagctaaaaacggaggaaaggagcagcgaacgaattatgagggtatggcctaatttgaaagaaagttcttgcaatttaaattatggtataatgcatttcttcccctaggtgctgtacatatattgtttaacaggaaataaacagccaggattttgaagttaaaggtcagaactgcattcaaatttgtcacaaactatgatcttggaaagattttttaaaactctctgatctgtttattcactttgataaatgaaaattatacatcagaagcattactttcaaaaagtgtgaaaacctgtagcctgcaatctgtcctgtagcatgttccccggggttaattttttttctttttaacccttattttgactttgctgttttttaatttcttcttattcataatagacagaaccttgttagagtaaggatagttaagcaattagatttcaaattgggtcggtctaaggtatggattgctgtgaagttagcaaatcaacaaagcatgtcaaaataacctgcttataaatgttaaatgcagaccagtggttaggccgggcacggtggctcacacctgtaatcccagcactttgggaggctgaggccagaggatcaccagaggtcggcggattacccaaggccaggagtttgagaccagcctgaccaacatggagaaaccccgtctctacttaaaaaaaaaaaaaaaaaaaaaaaaaatatatatatatatatatatatatatatatatatacacacacacacacacacacacacacatacatacatacatatatacacacacatacaaaattagccaggtgtgatggtgcatgcctgtaatcccagctacttgggaggctgaggcaggagaattacttgaacctgagaggcagaggttgtggtgagccgagatcacaccactgcactccagcctgggcaacaagaatgaaactctgtctcaaaaaaaaaaaaaaaaattattgaggtctaaattctgtgcaagtctggagattcagtaatcattctgatttttgttaacatttgacttttaccaacagtgaactacattgtagaaaactgactttttttgcatgatagtatagtattccataataacatttgtcaactttaggtgtctgttaatatgctttttattaaggcaattaaaaaaattatctttgtttaaagaaacctttctctaaatagtgtagttaacaagagtggccattctcaattttaaaacacagtggtaaaacccatggaagtttccacatttaaaacacatggagtctttgatctggttagttatgacactgattcttcttgagggctgtgtttatgacaccaaataagtcatctagtttgtttccatttattgtttttaatattaagacagtgatgtaagcaggagtgaccaactagtttctattctaggaagcaggtgatatatgagggataattgaataacttaaacacggtgagaattatacattaaatagagtccatcctacccctctttttaaaaaagcaatttaattttggataggcaggaggggaagattttcctacaggcagttggataggtcagacactatggcacttacattccatttcttaggaagtatgcaaaactgtttttaaattgtgttagtataagaagtatttaagtactttatggaacaaaaatctggctctgtttgtgagcagtttgttttcttctatttaaataattggattatctccctgtataaacatggaaccatgtgagggtggtggttttgcaatcttcataaatgtatatatttagatctgctcatgctggggttaccattagcaccagcagtctgtcaacatttccacagggtcttttaagtatgttgtgaaagctccagccaacacttggcataagtaatctgtacaacacagcagtttcaagctaaggcttataggatagcacgcatgctaacttttttttattatactttaaattctgggatacatgtgcagaatgtgcatgtttgttacataggtatatatgtgccatgttggtttgctgcacccatcaatccgtcttctaggttttaagcccggcatgcgttaggtatttctcctaatgctatccctctccttgcccccaccccctgccagacaggccctggtgtgtgatgttcccctctctgtgtccatgtgttttccttgttcaacacacacatgctaactttaagcatacttttcttttggtgttggaagaaatttatggagtacaattttttttttccctcactgattcaagcaggtggcttattttctagaacttaggatgtgattcttcccttgtttcaaaaacatcatctctttctggaaaaatgagcaacacccaaccatcctatgttttacttctgattcaactaattaatgttattggtgttagcagttgtacaaattgaggagctcgtgattctggtagcatattttcccacttaaatagttcagttttccgatgcatgtgttgtgatccttaattgtacactttttttcattacctgtgagaattaacgtctagtgtagggatatgcattaagatttttgtgtcaaaagagtttctagggggaaaaaggggagtaattcttatagggcttggtttcccaaagtgttaattatgggaagggcttcatcatttggggaattgtttatgctaaattgaggtctcacgattttaatttcttattggggcctatagataactacttttttcttgtgttttgtctttttacttgatttggggtattcatgactgtttttggaaatgttccctggagaatttctttcctttttttgagacggagtctcgctctgtcgcccaggctggagtgcaggggcgcgatcttggctcactgcaagctccacctcctgggttcacgccattctcctgcctcagcctcctgagtagctgggactacaggcgcccgccaccacgcctggctaattttttttattattttatttttatttatttttatttttttaagacagagtgtcgctcttgtcacccaggctggagtgcagtggtgagatctctgctcactgcaagctccacctccctggttcaagccattctcctgcctcagcctcctgagtagctgggactacaggcgcccaccaccacacctggttaatttttttgtatttttagtagagacagggtttcactgtgttagccaggatcatctcaatctcctaacctggtgatctgcccaccttggcctcccaaagtgctgggattacaggcatgagccaccgtgcccgggagttccctggagaatttctaagtcccacttatttcagttgaatcctgttctacttgagcttctcactctgactggttctcagttggctagggcatagaactggcttggcaaagtgctaaatttagctttccttgagcctctctctgtggtgctaagcctatgatttaaaaaaactcaaaaaaaaaacacaaaactctcaaaagtatcttgccttgctattgatgtgtcccccacaaaaatatttctcaaaagtacctttcattgccattgatacacatcagcagctcctttggaatatctctgactcccccaccagatgcacaagccacatgtgctgcttatgttttgggtgggaaatgttgaagggacactgctttgtttcaaggtaaaatgtattgaaccaaagttatttttcttctgatgaccaccgtgattatttgctttggtctgtatcctttaaatctcctccagtttgacagattatctcgaatgttaatgatgtgtgtaaattgttagaatgagaatgtgtttatcatgttctgtgcaggtccattgtgccctcaagcagaaccacctaagactccacatttattttgcaaccatacctcagttcatcgtctttccttgaaccgtagttattaagtattctgagctgccctgtgacgtcttaattaaatcagactttgaagcattcatgacacatacctcatagatcattcctgtttcttttgtgctgtgttaaatacatatatttttccagtgacccatgctatggccatagttaatccaggttgtgaatgtccttcagaggtgccaatgtatgaggattacaactggaatggtgctggcactggagagtatttaagggctaatagttctggtaattttcttcattttttttttttggaagatattagcacttcatgtgttaaaaatagatctgtgactctaactttctcccccaatatttaaaaactcctaggtttggttgggcacggtggctcatgcctgtaatttcagcactttgggaggctgaggcaggcggatcacttgaggccagaagttcgagaccagcctggccaacatgacaaaattttgtctctactaaaaatacaaaaattagctgggtgtggtggcacaagcctgtagtcccaactactcgggaggctgaggcacgagaatcacttgaaccttggaggtggaggttgcagtgagccaacatagtgccactgcgctccaacctgggcgacacagtaagactttgtctcaaaacaaacaaaaactcctagtttctcctagctttgagtttttgtacagtgaaatacatattttaataggagaagccaaatgatctaagacctttaatcctgatgtcattaaaaatattcatttgtagagatgatttccatatttgaggggcttacaaatgtttagaaataccattttcccaaggaaatactcctagacaattatatgtccaatcttttattcctaattgatatgatttattaatatttaaataatattgttagataaattaatatgagtttctcaaagttaatgcttctcgggaggttaaagctttgtaaaccttgtacctaaaaatatcattctctattaaagaactcaagaaaagataaaaagattctgagaaaatatgggttatttttatttttatgtttttggagatggagtcttactgactggagtacagtggcgcacgatcccaactcactgcaacttctgcttcctgggcgcaagcaattctgtctcagcctcctgagtagctgggattacaggcatgcggcaccatgcccagctaattttgtatttttagtagagacagggtttcaccatgttagccaggctggtcttgaacacctgacctctaggtgatcggcctgcctcagccttccaaagtgctgggattacagacgtgagccaccattgcctggccataaatacagtttaattctaggagttctagaattttgaaatttttgatacaagctttgatcttgattatcaatttttttctagattaaatttatgttaatatagcccttctaaatattaaaggaaatttagaaatttacctttaagctttattaacatttttaatcatggtatttattttctatccaaggcatgatgcttataatggtgatggtctagcattaaaatttgttgtctttacattcacaatcggactactgggtttgatatttaaatatttataattttatataaaactaagcaaagtatcttaagataggcattttccattttggtcaaatcttgtgtggcacattaattcattacgttgattgcttaattgagtttgagcttggtagtatacatgattacaggatttttataccactgctgccaagatctagtggggagaatgtatccaacttgatttctatagcatccgacatgcaagttccctgttattggtgccagagttgggtttcccccctacctctctcaatcctgctccttctatgggtttttttttttcttccttaaatacatatcttgaacttgaggttaagaagaggcatacattagcaattttgtgatattaattgatgaagttaatattaattgttcatttaaaaatttgttgaacttgcaacattatttgaccagcaaatacagagtgaggctaagatgccaacagcccactgttcagtcttattattttcagaattagaaatctgtacctttgtcaggatggatgccttcacctagaaggaattcagatttcttcttgcttggcaagggctaactgcagaaacaacggaacacatttttttaaaagtcaggagtatattagaaacacatgggcattcaacacctacataaaatactctatgagataaatgtgaataactggatttaacaaagggccagactttagaataccagaattcataaaaaggctaaacttactttataatttaaggggaacacaaatcaactaattagaattaataataaagagtaatacctatgctgcttttttctctcttgatataactgtttgtgatttaggtagtgttaccttgtttcagtctcatggtttttcttgtttgctaaatccctataatattccttttcccatcaaggggatatgtgtgggtttgtgctagaatcactgtttatgactattttcaggattttccatgttttatgagatatatttcatctttagaattttgggtgggtctagatttagaaaactgttttggttggaatgataaggctctggatctcagcgggctttagggttggaaaagttgaagctcacagagagcaaataaacatggtcatcaaagctgagaattaagatctgtttatccacctgcacacttgaattaaatctcagagcaatgggcagagccattcaacttatgaagatcctgacaaaataaattactctattcatgtttaaacgtctattttttgcctgtgtttagacacagaggttggtgtagtgaccatgtggtagatggagaagttcttgtggaattactaagctattgatttacaacagggagaatgccactaaaatagtggacaatggtgaattaaatggaaaagtctgtttgaggtttggggcaagaagcttcaaattgtaaaaatcacatgggctcttgtccttcagcactgagcagcatcatgattgaagattggagaaagtggggagagagtactcaggttaggtgtggttcacatcacttttgctttaagggaattcctcgtgtgtagggttataaagataacctaagatatggacttgggtaagtattccctaattcattttcattgtttaagtctgttgaggttcaagtaaataaaacaatgcttttaataataccttttttaaaaaatgcagggcacagtttgttgactctgagatctttgtggtcaagatgaaagttggctcctgatacataaaaacaaaacaaaaagcctttaatttgtgttgattctcttggttctgtaattctcttttctctatacttcttactgtggagcatgatttatggtgataaagagctttggtttaacttttgaactgaaagtatagcttcaactttagcatgtgatgactgtaggacagtgaacctcctccttaaaccattctgctgtgtacttgtaaaccttccagaatctccttttatttataaagctagatttgggttggatatttccttgggtaattgcttgatcttggtttttcaaatctgcatataaattctagagcagaagttcgtcagtatgtttcagagggctttgtagtgtggggctacttctgatgtagcttcagccagcaacccttgcccttgccttagtctctcagttgttcatgttaaaggggtggctttttcgtgaaagagtcataaattgtttctctaaatatcattccatagggtcttcatgcttaaggtgggttacaatcttggacaaccctgaaaatgaacaagagttggattctctctagctaccttttcctccaccatagccatttcctcacacagcctgtcagtattcccagtttcattgctcttctccagcttttcccatctccctcaattttttaccctttctggcacagagaagttaaacgatatcctaatttttttgaacctcactcacttacaccctactcaggatactaagaatgataccagaataaaacctcttcagaaggcagctggaaaaattgtagatagtataagcttatttttggtcagctatgcaaaaatgattttcaaatcataattatctggcaatattaaggtgtaacaaaataccatagtgagtataaaagcaggaaaattgagcaatagaatgtagagtgaagtagggagaggtaggtctagggttgggacttcataactattcaaatgagaagtgataaaggcctgaattatgagaagattcatggaaatgacaaaggtgagggtcagaatcaaatctgtaggagaagatattatcatagaagctagaggaggaagaaaaccttcagcaacctaggctattggaattgtgaggatcagaaattgagaatgagatcttgaatgagggatgagaaaactggttgtggtcttcataaaagcagttttagagataattcagcagaggatggtgataagtagaggcaacaggtttaactgacactttgaagaaatgtgacggtgacattggtttggttcattgttatggaaagatgctaacaacttagctgaaattgaacaagttatgacccaacaggtacagtatgatgtgtatgaaaaacacaaattatataatgtatacatgcatatatatataaaggagcatttggaaagtcgcttacccagaattttattggtaactgtatctgaggtgatgatttttcatcagaattggttccctagctctgccccccaacaattgcagatttagggaaataaagtattaaatgagaattatttggaaagcatagataggttttcaagtgagagaatgtccatgaaatagattcaacatgcaaataaaagagaacagttgatagaaaagagtcctagaatagatgtgaagagtagatctttctggccaattcaagatgttatattggccttgattcctgatcctgaagggccttgtttcttgtttggtccctttggtagaataagccctggttttgggacttcctggatgagaggctgtgggaagctttggggaagaaggaagactctcttgtggatctaaaatctgtgtagatttgctgcaagttgctataaatataatggccattaaattgttataataaaggaatgacatggtatacaatgtactctgtatagctgccagtctgaccacttattgcttgatattagttttatacacaagactgattatatggagggtaaacaacatgtagtctcaaagctaaaagtttcaataattgatgagttttctatttcttctctcctaattctttcttgggttaactcgataaaatgaagtcattgtggcctcatgtattctgttgtatttatgaccttgcttggcgtagtgaaaactaaaagttacatgaatttttaatattttagaaattataatatttcagattgtatcatttctacattttataccagctataggaaagagtattttgtgtcttttcttttaaggtacgattgtccccatcagatgcagtgaacttcatatggttcaggtattaacttatcttagatgctatttcgacatttgcttagtactgtcttctcccaccatgtcccatcagtaggatatttctgtttggaaaaaaaaagtaaataatatcttactggtgagtaatataatttatggaatcttcaaaagaggtgtaattgtaagtaagtacattgtactgaaattagcacatagcctttatatgctttactttttctaatgagatataatttacttgtaaattatgcatattaattgtaaaaatgtacaaatatacttagataaatgcatagttttgggttttgcaaatgtatacatttgtgtaaccaaaatccaggcaagatatagcacatttccatcaacccctttagcgaattgactagtgcacagggtaaacttgtgtcatgggggttttctgttttattttctccaatattcaccccatgaccccaactcatatcctcctggaaacttagaaggtgaccttttttggaaacagggtctttgcagatgcaacgaagatgatgaagatgagattctatgggattatgggataaagatgggccttaaatccaattagagtgtcaatgtaagagacagaaaaagacacagagatacaagagaagaaggcataagacaatggaggcagggattgacttcatgtaactatgagccaaagaatgccttgggctaccaaagactgaaagaagcaagaaaggatttgccagagtccttgagaggaagcacgccctgctgatacgatattgggatttcagacttctagtctctagaattgtgataataaattcctgttgtttaagccaccaaattgtggtcatttgttacagcagcccaaggaaactaatatacctcctccatcccccgcaaattctattatgcccctttccagtcagtcctcaatcctcaaaggcatgtagtagtcttatttctatcaccacagattagccgtgcctgcctttgaccctaatataaatgaaattatctagagcatgctcttttttgtatctgtttggattcttttgaccagcataatgtatgtgaatttcattcatgtcatgtgtatctgtattatcctttttattactgagtaaaactcaaatagtttgaatataccgtaatttgtctattctgttcatagatattcggattgtttcttcctacccatattttatacatatattacatcttttgtagctgtcactggtttagaagttatagattctgttattgtttttgtagttaggaacttaaagttatagtaattacattttaatttacattagtcttcctcactgataatgcggaaactctgaatgctttaagtttggcttccttctcaagtcttctgtgttatttttgtgaatataagatatttagtttcaaaacttgaaaatcattatatgttttttacatgctatgcttttgtatagagacatgaacatgtttttcaattggtgtgatcactatagcttgttgcattctacttcctctgggttctgttttattttctccaatattcagagtttaatcttttagttaatgctttaaaaaaaattaagatatttgcctttactttggctaaaatatcttcattttgctcacctggttaaactataactgcttatagaattatagtttgataatttttcctcaacatgttgaagatagtatctcggctatctaatctttatttttttctaagtctgctgtcagtcaaagttttatccttatctagataatctgctattcctctctggcttgactttattctcatggcatgtaaatgtactgcatttagatgtagacttgtttggtctcttaatttttaatctaagaactcatgtctttatctggaaattaatcagccattatctctttgaacagtgtgttttattccttttttaacatatacttttaagttcacgggtacaagtgcaggtttgttacataggtaaacttgtgtcatgggggttttctgtacagataatttcatcacccaggtattaaggctagtacccattagttatttttcctcatcctcatcttcctcccatcctctgccctccaataggcaccagggtctgttgtttccctctatgtgtccatgtgttctcatcattaagctcccacttataagtgaaaacacggggtattttgttttctgtttctgtgttagtttgctaaggataatggcctccagctccatccatgtccctgcaaaggacatgatctcattcttttttatggctgtatagtattccatggtgtgtgtgtgtgtgtgtgtgtgtgtgtgtatcacattttctttatccagtcagttgttgatgggtacctaagttgattccatgtctttgctattgagaatagtgctgcaatgaacatatgtgtgtatgtgtctttataatagaaggatttatattcctctgggtatataccccgtaatgggattactgggttgaatggtttttccatctttaggtttttgtggaattgccacactgtcttccataatggttgaactaatgtacactatcacaaacagtatataagcgtttctttttctccacaacctctcagcatctgttattttttgactttttaataatagctattctgactggtgggagatggtatctcattgtgatttcttatttgcatttctttaatattcagtgatgttgagttttttcatatgattgttggccacgtgtgtgtcttcctttgagaagtgtctgttcatgtcctttgcctgcttgttaatgatttttttccttgtgaatttaagatctttatagatgctaaatattagacctttgtcagatgcatagtttgcaaatattttctcccattctgtaggttgcctgttcagtctgatgatattttcttttgctgtacagaagctctttaattagatcccacttatcaatttttgcttttgttgcaattgcttttggcatctttatcatgaaatctttgcctgtgcctatgtcctaaatggtattacctaggttttcttccagggtttttatagttctgggttttacctttaagtctttgatgcatcttgagttaatttttatatatagcataaggaaggggtccagtttcaatcttttgcatatagctagccagttatcccagcatcatttattgaatagtgaatcttttccccattgcgtgtgtgtgtgtgtgtgtgtgtgtgtgtgtgtgtgtgtgtgtttgagatggagtttcactcctgttgcccaggctggagtgcaatggcacaatcttggttcaccacaacctctgccttccaggttcaggcagttctcctggcttagactcccaagtagctgggattataggcattcgctaccatgcccagctaattttgtgttttgtttatttatttattttttgtagagatagggtttctccgtgttggtcaggctgatcccaaactcccgacctcaggttatctgcctgcctcggcctcccaaagtgctgggattacaggcgtgagccaccgcacccagcccctcattgcttgttttggtcaggtttgtcaaagatcagacagttgtagatgtgtggtcttatttctggatactctattctgttccattagcctgtctgttcttgtatcagtaccatgctgttttggctactgtagctctgtagtatagtttgaagtcaggtagcatgatgcctccagctttgttatttttgcttattattgccttggctatttgggcttttttttggttccatgtgaattttaacatagttttttccagttctgtgaaaaatgtcaatggtagtttaatggaaatagcattgaatcgataaattgctttgggcagtatggctattttaataatattgattcttctatccatgagcatggaaggtttttccatttgtttgtgttatctctgatttcttgggtagtgttttgttgttctccttatagagatctttcatctccttagttacctgtattcctaggtattttattatttttgcagcaattgtgaatgagagtttgtttgtgatttgactcttggcttgactgctgttggtgtgtaggagtgctagtgagttttgcatgttgattttgtatcctgagactttgctgaagttgcgtctcattttaaggtgtgttttattcattctctttactctttccttctgtagtaactactaatcatgtattggaacgtttctgtttttttcttacatgcttagtacctttttatcttgttttgtgctacagttatttaaaagtgtttttggttatgtcattctcttctaccattcaatttgtccatagaattttttgttaagttttagaattttcatttcattgtaatgtgcacattcttgctttttcccatgtgatttctagttatccctttatctcttcagatattctgtagatattcattttaaagactcctttagaatgtccttatttctggttttttaggtgtgaagttttcttgttactgatattgttgactgttcctcatgaaggtttacttgctcatatgatttgttcatcttgatgttaaggtagcatttcatgaaagtctaggtctcaggattgtagaaaatatctagagagtaattctatatttatttattttttctttctgggttttcctggatctggacaaattcttattttaacttgtcaacatcatatagcccccatgctacaatgataattttgatttggatcccagccttgtggacttggtgttctgatgtctcatgaattatattttctcttgtgcttacctgctgtgtgctcccaagctagggtcagaatcccctgctctagccagttagggcagggggtcatggacaaacagccccatttactccatctacataaagggagctaagtgctagatcttcacataaatatttcttggcctgggttgaggaccttgccctaagttctacctctgtctggtctgacatccccatgagccattcagctttagcttctggcctcaactctgcctctgagtttcctctttgtttctaagtttggttgtgtattaacaactttttgggtggaggaggtagagggaagaaggggagggatattttatttagtatttctatgtgagtatagcagaaagaaaagaaacatttgtcttttcagcaggtgtatttaccaaaaatctgattatactgataattaaacacaatttttgtttttcttttacagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattc

SEQ ID NO: 34 - DNA, 263 bp, Artificial sequence
  Exon 2 of the human RSPO2 gene (ENSE00001378581)
gttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgag

SEQ ID NO: 35 - DNA, 46 bp, Artificial Sequence
  Forward primer for EIF3E(e1)-RSPO2(e2) fusion
tcggcatctagtctttccgcttyggagaaggaaactaraacccagt

SEQ ID NO: 36 - DNA, 23 bp, Artificial Sequence
  Forward primer for EIF3E(e1)-RSPO2(e2) fusion
tcggcatctagtctttccgctty

SEQ ID NO: 37 - DNA, 18 bp, Artificial Sequence
  Reverse primer for EIF3E(e1)-RSPO2(e2) fusion
agttcagcgcgatcagca

SEQ ID NO: 38 - DNA, 115 bp, Artificial sequence
  Exon 2 of the human EIF3E gene (ENSE00003610725)
atatataatgaaaaggaattattacaaggtaaattggaccttcttagtgataccaacatggtagactttgctatggatgtatacaaaaacctttattctgatgatattcctcatg

SEQ ID NO: 39 - DNA, 19 bp, Artificial Sequence
  Forward primer for EIF3E(e1/e2) WT control
gcatctagtctttccgctt

SEQ ID NO: 40 - DNA, 21 bp, Artificial Sequence
  Reverse primer for EIF3E(e1/e2) WT control
acatccatagcaaagtctacc

SEQ ID NO: 41 - DNA, 169 bp, Artificial sequence
  Exon 1 of the human RSPO2 gene (ENSE00002106748)
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattg

SEQ ID NO: 42 - DNA, 20 bp, Artificial Sequence
  Forward primer for RSPO2 (e1/e2) WT control
acgtgctaaccaagcggctc

SEQ ID NO: 43 - DNA, 21 bp, Artificial Sequence
  Forward primer for RSPO2 (e1/e2) WT control
ttctgccttctacagctcgga

SEQ ID NO: 44 - DNA, 21 bp, Artificial Sequence
  Reverse primer for RSPO2 (e1/e2) WT control
ttcagcgcgatcagcatctct

SEQ ID NO: 45 - DNA, 18 bp, Artificial Sequence
  Reverse primer for RSPO2 (e1/e2) WT control
agttcagcgcgatcagca

SEQ ID NO: 46 - DNA, 22 bp, Artificial Sequence
  Probe for PTPRK(e1)-RSPO3(e2) fusion
  misc_feature (1)..(1): 6-carboxyfluorescein (6-FAM)
  misc_feature (22)..(22): Black Hole Quencher-1 (BHQ-1)
ccagytcycckcagtgcatcct

SEQ ID NO: 47 - DNA, 21 bp, Artificial Sequence
  Probe for PTPRK (e1/e2) wild-type control
  misc_feature (1)..(1): Texas Red (TxRd)
  misc_feature (21)..(21): Black Hole Quencher-2 (BHQ-2)
aagtacagccacctgcggaga

SEQ ID NO: 48 - DNA, 21 bp, Artificial Sequence
  Probe for PTPRK (e1/e2) wild-type control
  misc_feature (1)..(1): Texas Red (TxRd)
  misc_feature (21)..(21): Black Hole Quencher-2 (BHQ-2)
aagtayagccayctgmggaga

SEQ ID NO: 49 - DNA, 21 bp, Artificial Sequence
  Probe for RSPO3 (e1/e2) wild-type control
  misc_feature (1)..(1): Cyanine 5 (Cy5)
  misc_feature (21)..(21): Black Hole Quencher-2 (BHQ-2)
tgcattcttcgctggcgcctt

SEQ ID NO: 50 - DNA, 22 bp, Artificial Sequence
  Probe for the internal control
  misc_feature (1)..(1): carboxy-2,4,4,5,7,7 -hexachlorofluorescein succinimidyl ester (HEX)
  misc_feature (22)..(22): Black Hole Quencher-1 (BHQ-1)
aggtcgggtgggcgggtcgtta

SEQ ID NO: 51 - DNA, 26 bp, Artificial Sequence
  Probe for the PTPRK(e7)-RSPO3(e2) fusion
  misc_feature (1)..(1): 6-carboxyfluorescein (6-FAM)
  misc_feature (26)..(26): Black Hole Quencher-1 (BHQ-1)
accagaasaaaatgtgcagtgcatcc

SEQ ID NO: 52 - DNA, 26 bp, Artificial Sequence
  Probe for the PTPRK (e7/e8) wild-type control
  misc_feature (1)..(1): Texas Red (TxRd)
  misc_feature (26)..(26): Black Hole Quencher-2 (BHQ-2)
atgtgcmgaacctatgagaaccccaa

SEQ ID NO: 53 - DNA, 26 bp, Artificial Sequence
  Probe for the PTPRK(e13)-RSPO3(e2) fusion
  misc_feature (1)..(1): 6-carboxyfluorescein (6-FAM)
  misc_feature (26)..(26): Black Hole Quencher-1 (BHQ-1)
aygcattgctacaaaagtgcatccta

SEQ ID NO: 54 - DNA, 31 bp, Artificial Sequence
  Probe for the PTPRK(e13)-RSPO3(e2) fusion
  misc_feature (1)..(1): 6-carboxyfluorescein (6-FAM)
  misc_feature (31)..(31): Black Hole Quencher-1 (BHQ-1)
actaacgttaggatgcamttttgtagcaatg

SEQ ID NO: 55 - DNA, 20 bp, Artificial Sequence
  Probe for the PTPRK (e12-e14) wild-type control
  misc_feature (1)..(1): Texas Red (TxRd)
  misc_feature (20)..(20): Black Hole Quencher-2 (BHQ-2)
aycccagatcccgccaagca

SEQ ID NO: 56 - DNA, 24 bp, Artificial Sequence
  Probe for EIF3E(e1)-RSPO2(e2) fusion
  misc_feature (1)..(1): 6-carboxyfluorescein (6-FAM)
  misc_feature (24)..(24): Black Hole Quencher-1 (BHQ-1)
scgccacgaacctcctttacagag

SEQ ID NO: 57 - DNA, 26 bp, Artificial Sequence
  Probe for EIF3E(e1/e2) wild-type control
  misc_feature (1)..(1): Texas Red (TxRd)
  misc_feature (26)..(26): Black Hole Quencher-2 (BHQ-2)
attggarcttcttagtgataccaaca

SEQ ID NO: 58 - DNA, 23 bp, Artificial Sequence
  Probe for RSPO2(e1/e2) wild-type control
  misc_feature (1)..(1): Cyanine 5 (Cy5)
  misc_feature (23)..(23): Black Hole Quencher-2 (BHQ-2)
ctccctaggcgcsgtgctccatc

SEQ ID NO: 59 - DNA, 608 bp, Artificial sequence
  Fusion A 1747:PTPRK(e1)+ RSPO3(e2),608:(5'-3')
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaa

SEQ ID NO: 60 - DNA, 539 bp, Artificial sequence
  Fusion A 1758:PTPRK,E1&2,539:(5'-3')
agaagcgcccggagcccgcggggcgacgtcacccccggctccgcccccgtccctccccgagcaaagtaactcttgactaacaggagcagcctccgccgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtggctgtacttttgatgatggtccaggggcctgtgattaccaccaggatctgtatgatgactttgaatgggtgcatgttagtgctcaagagcctcattatctaccacccgagatgccccaag

SEQ ID NO: 61 - DNA, 579 bp, Artificial sequence
  Fusion A 1759:RSPO3,E1&2,579:(5'-3')
gcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaatgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaa

SEQ ID NO: 62 - DNA, 486 bp, Artificial sequence
  Fusion B 1848:PTPRK(e7)+RSPO3(e2),486:(5'-3')
aaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaa

SEQ ID NO: 63 - DNA, 597 bp, Artificial sequence
  Fusion B 1857:PTPRK(e7,e8),597:(5'-3')
aaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatg

SEQ ID NO: 64 - DNA, 503 bp, Artificial sequence
  Fusion C 1846:PTPRK(e12,e13)+RSPO3(e2),503:(5'-3')
tgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagtgcatcctaacgttagtcaaggctgccaaggaggctgtgcaacatgctcagattacaatggatgtttgtcatgtaagcccagactattttttgctctggaaagaattggcatgaagcagattggagtatgtctctcttcatgtccaagtggatattatggaactcgatatccagatataaataagtgtacaa

SEQ ID NO: 65 - DNA, 450 bp, Artificial sequence
  Fusion C 1847:PTPRK(e12,e13, e14),450:(5'-3')
tgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggaaactaaaacccagtgcgtacgcattgctacaaaagcagcagcaacagaagaaccagaagtgatcccagatcccgccaagcagacagacagagtggtgaaaatagcaggaattagtgctggaattttggtgttcatcctccttctcctagttgtcatattaattgtaaaaaagag

SEQ ID NO: 66 - DNA, 381 bp, Artificial sequence
  Fusion D 1849:EIF3E(e1)+ RSPO2(e2),381:(5'-3')
gagcacagactcccttttctttggcaagatggcggagtacgacttgactactcgcatcgcgcactttttggatcggcatctagtctttccgcttcttgaatttctctctgtaaaggaggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgag

SEQ ID NO: 67 - DNA, 233 bp, Artificial sequence
  Fusion D 1850:EIF3E(e1,e2),233:(5'-3')
gagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatg

SEQ ID NO: 68 - DNA, 432 bp, Artificial sequence
  Fusion D 2029:RSPO2-004(e1,e2),432:(5'-3')
agaagcatcccaagcctcagccggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgag

SEQ ID NO: 69 - DNA, 102 bp, Artificial sequence
  internal control target sequence 1148: IC sequence for IC77 PCR, 102 b:
ctagcagtggcgcccgaacagtatcgcgtttatgcgaggtcgggtgggcgggtcgttagtttcgttttgggtgactagcggaggctagaaggagagagatgg

The invention claimed is:

1. A method of treating a malignancy in a subject, comprising:
    amplifying nucleic acids extracted from a sample from the subject in a multiplexed amplification reaction with a primer pair capable of amplifying a PTPRK(e13)-RSPO3(e2) gene-fusion,
    detecting amplified PTPRK(e13)-RSPO3(e2) gene-fusion with a probe having the sequence of SEQ ID NO:53, and
    treating the malignancy in the subject when the PTPRK (e13)-RSPO3(e2) gene fusion is detected.

2. The method of claim 1, further comprising amplifying the nucleic acids with one or more of primer pairs capable of amplifying a PTPRK(e1)-RSPO3(e2) fusion, primer pairs capable of amplifying a PTPRK(e7)-RSPO3(e2) fusion, and primer pairs capable of amplifying a EIF3E(e1)-RSPO2(e2) fusion, and treating the malignancy in the subject when one or more of a PTPRK(e1)-RSPO3(e2) fusion, a PTPRK(e7)-RSPO3(e2) fusion, and a EIF3E(e1)-RSPO2(e2) fusion is detected.

3. The method of claim 1, wherein the sample is formalin-fixed and paraffin embedded (FFPE)-fixed tumor tissue or tissue from fresh-frozen tumor.

4. The method of claim 1, wherein the nucleic acid is RNA.

5. The method of claim 1, wherein the amplification step comprises a real time-PCR amplification reaction.

6. The method of claim 1, wherein the malignancy is a gastrointestinal cancer of the pancreas, stomach, small intestine, large intestine, colon, rectum, or anus.

7. The method of claim 1, wherein the method comprises treating the subject with an inhibitor of the Wnt signaling pathway.

8. The method of claim 7, wherein the inhibitor of the Wnt signaling pathway is a porcupine inhibitor selected from:
    2-(1,3-dimethyl-2,6-dioxo-1,2,3,6-tetrahydro-7H-purin-7-yl)-N-(6-phenylpyridazin-3-yl) acetamide, 2-(1,3-dimethyl-2,6-dioxo-2,3-dihydro-1H-purin-7(6H)-yl)-N-(6-phenyl pyridazin-3-yl)acetamide,
a compound of the formula (IV):

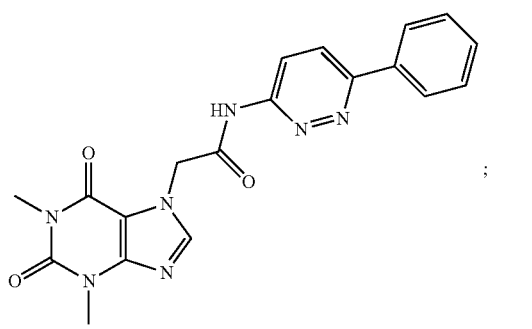

(IV)

4-(2-methyl-6,7-dihydropyrazolol [1,5-a]pyrimidin-4(5H)-yl)-4-oxo-N-(6-(pyridin-3-yl)pyradizin-3-yl)butanamide, and
a compound of the formula (V):

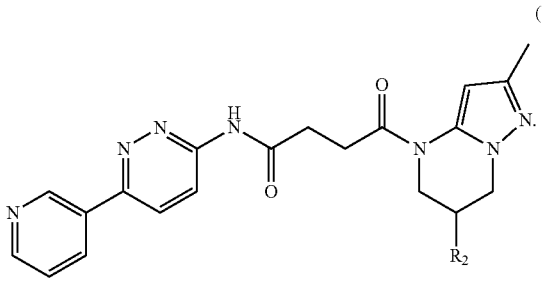

(V)

9. A method of identifying and treating a subject suffering from a malignancy, comprising:

amplifying nucleic acid extracted from a sample from the subject in a multiplexed amplification reaction with a primer pair capable of amplifying a PTPRK(e13)-RSPO3(e2) R-Spondin gene-fusion, detecting amplified PTPRK(e13)-RSPO3(e2) gene-fusion with a probe having the sequence of SEQ ID NO:53, identifying sensitivity to an inhibitor of Wnt signaling when a PTPRK(e13)-RSPO3(e2) R-Spondin gene-fusion is amplified, and treating the subject identified to be sensitive to an inhibitor of Wnt signaling.

10. The method of claim 9, further comprising amplifying the nucleic acid with one or more of primer pairs capable of amplifying a PTPRK(e1)-RSPO3(e2) fusion, primer pairs capable of amplifying a PTPRK(e7)-RSPO3(e2) fusion, and primer pairs capable of amplifying a EIF3E(e1)-RSPO2(e2) fusion, and identifying sensitivity to an inhibitor of Wnt signaling when one or more of a PTPRK(e1)-RSPO3(e2) fusion, a PTPRK(e7)-RSPO3(e2) fusion, a PTPRK(e13)-RSPO3(e2) fusion, and a EIF3E(e1)-RSPO2(e2) fusion is amplified.

11. The method of claim 1, wherein the primer pair capable of amplifying a PTPRK(e13)-RSPO3(e2) gene-fusion comprises a reverse primer comprising SEQ ID NO:7 or a complementary sequence thereof, and a forward primer comprising SEQ ID NO:6 or a complementary sequence thereof.

* * * * *